(12) United States Patent
Wandall et al.

(10) Patent No.: US 9,588,121 B2
(45) Date of Patent: Mar. 7, 2017

(54) METHOD FOR EARLY DETECTION OF CANCER

(75) Inventors: Hans H. Wandall, Gentofte (DK); Johannes W. Pedersen, Valby (DK); Eric P. Bennett, Kgs. Lyngby (DK); Henrik Clausen, Holte (DK); Ulta Mandel, Holte (DK)

(73) Assignee: GO THERAPEUTICS, INC., Beverly, MA (US)

( * ) Notice: Subject to any disclaimer, the term of this patent is extended or adjusted under 35 U.S.C. 154(b) by 877 days.

(21) Appl. No.: 13/505,827

(22) PCT Filed: Nov. 5, 2010

(86) PCT No.: PCT/DK2010/050297
§ 371 (c)(1),
(2), (4) Date: Jul. 16, 2012

(87) PCT Pub. No.: WO2011/054359
PCT Pub. Date: May 12, 2011

(65) Prior Publication Data
US 2013/0059744 A1 Mar. 7, 2013

Related U.S. Application Data

(60) Provisional application No. 61/259,023, filed on Nov. 6, 2009.

(30) Foreign Application Priority Data

Nov. 27, 2009 (DK) .......................... PA 2009 70234

(51) Int. Cl.
| | |
|---|---|
| G01N 33/53 | (2006.01) |
| G01N 33/574 | (2006.01) |
| C07K 14/00 | (2006.01) |
| C07K 16/00 | (2006.01) |
| C07K 16/30 | (2006.01) |

(52) U.S. Cl.
CPC ....... *G01N 33/57484* (2013.01); *C07K 14/00* (2013.01); *C07K 16/00* (2013.01); *C07K 16/3092* (2013.01); *C07K 2317/732* (2013.01)

(58) Field of Classification Search
None
See application file for complete search history.

(56) References Cited

U.S. PATENT DOCUMENTS

| 5,660,834 A | 8/1997 | Kjeldsen et al. |
| 5,747,048 A | 5/1998 | Kjeldsen et al. |

FOREIGN PATENT DOCUMENTS

| EP | 1808442 A1 | 7/2007 |
| WO | WO-9320841 A1 | 10/1993 |
| WO | WO-0175110 A2 | 10/2001 |
| WO | WO-2004009632 A2 | 1/2004 |
| WO | WO-2004019040 A1 | 3/2004 |
| WO | WO-2004081186 A2 | 9/2004 |
| WO | WO-2005112542 A2 | 12/2005 |
| WO | WO-2007047489 A2 | 4/2007 |
| WO | WO-2008021290 A2 | 2/2008 |
| WO | WO 2008/040362 * | 4/2008 |
| WO | WO-2008040362 A2 | 4/2008 |

OTHER PUBLICATIONS

Sorensen et al (Glycobiology, 2006, 16:96-107).*
Sorenson et al (2006, Glycobiology, 16:96-107, IDS).*
Ahlquist D.A., et al., "Stool DNA and Occult Blood Testing for Screen Detection of Colorectal Neoplasia," Ann. Intern Med. 149(7):441-450, W81, 2008.
Anderson K.S., et al., "The Sentinel Within: Exploiting the Immune System for Cancer Biomarkers," J. Proteome Res 4(4):1123-1233, 2005.
Baseler M.W., et al., "Circulating IgA Immune Complexes in Head and Neck Cancer, Nasopharyngeal Carcinoma, Lung Cancer, and Colon Cancer," Cancer 59(10):1727-1731, 1987.
Brocke C., et al., "Synthetic Tumor-Associated Glycopeptide Antigens from the Tandem Repeat Sequence of the Epithelial Mucin MUC4," Synthesis 4:525-542, 2004.
Chen Y.T., et al., "A Testicular Antigen Aberrantly Expressed in Human Cancers Detected by Autologous Antibody Screening," Proc Natl Acad Sci USA 94(5):1914-1918, 1997.
Etzioni R., et al., "The Case for Early Detection," Nat Rev Cancer 3(4):243-252, 2003.
Garcea G., et al., "Molecular Biomarkers of Colorectal Carcinogenesis and their Role in Surveillance and Early Intervention," Eur J Cancer 39(8):1041-1052, 2003.
Gebauer G., et al., "mRNA Expression of Components of the Insulin-Like Growth Factor System in Breast Cancer Cell Lines, Tissues, and Metastatic Breast Cancer Cells," Anticancer Res 18(2A):1191-1195, 1998.
Hakomori S., "Tumor-Associated Carbohydrate Antigens Defining Tumor Malignancy: Basis for Development of Anti-Cancer Vaccines," Adv Exp Med Biol 491:369-402, 2001.
Hakomori S., "Glycosylation Defining Cancer Malignancy: New Wine in an Old Bottle," Proc Nati Acad Sci USA 99 (16):10231-10233, 2002.
Hospital V., "Cancer Facts and Figures," American Cancer Society, Atlanta.

(Continued)

*Primary Examiner* — Laura B Goddard
(74) *Attorney, Agent, or Firm* — Leason Ellis LLP

(57) ABSTRACT

The present inventors have demonstrated that circulating auto-antibodies to cancer antigens hold promise as specific and sensitive biomarkers for the early detection of cancer. The present invention thus relates to methods of detecting cancer in a sample, comprising utilizing a glycopeptide bait derived from human mucins with different cancer-associated O-glycans. Detected antibodies were demonstrated as glycopeptide specific, and it could be discriminated between e.g. colorectal cancer patients and healthy individuals. The inventors have also developed monoclonal antibodies based on the identified glycopeptides epitope baits, and demonstrated differential expression of the relevant target antigens. The invention thus, in a lock and key-based manner includes both glycopeptides and antibody tools for early detection of cancer, as well as methods of using the same for in situ visualization and treatment of specific cancer types.

7 Claims, 43 Drawing Sheets

(56) References Cited

OTHER PUBLICATIONS

Hsiung P.L., et al., "Detection of Colonic Dysplasia in vivo Using a Targeted Heptapeptide and Confocal Microendoscopy," Nat Med 14(4):454-458, 2008.
Itzkowitz S.H., et al., "Sialosyl-Tn: A Novel Mucin Antigen Associated with Prognosis in Colorectal Cancer Patients," Cancer 66(9):1960-1966, 1990.
Iwai T. et al., "Core 3 Synthase is Down-regulated in Colon Carcinoma and Profoundly Suppresses the Metastatic Potential of Carcinoma Cells," Proc Natl Mad Sci USA 102(12):4572-4577, 2005.
Jemal A., et al., "Cancer Statistics, 2005," CA Cancer J Clin 55(1):10-30, 2005.
Jonckheere N., et al., "A Role for Human MUC4 Mucin Gene, the ErbB2 Ligand, as a Target of TGF-Beta in Pancreatic Carcinogenesis," Oncogene 23(34):5729-5738, 2004.
Ju T., et al., "Human Tumor Antigens Tn and Sialyl Tn Arise from Mutations in Cosmc," Cancer Res 68(6):1636-1646, 2008.
Jäger E., et al., "Humoral Immune Responses of Cancer Patients Against 'Cancer-Testis' Antigen NY-ESO-1: Correlation with Clinical Events," Int J Cancer 84(5):506-510, 1999.
Kaetzel C.S., "The Polymeric Immunoglubulin Receptor: Bridging Innate and Adaptive Immune Responses at Mucosal Surfaces," Immunol Rev 206:83-99, 2005.
Kim H.J., et al., "Noninvasive Molecular Biomarkers for the Detection of Colorectal Cancer," BMB Rep 41(10):685-692, 2008.
Liu W., et al., "Proteomics-based Identification of Autoantibody Against CDC25B as a Novel Serum Marker in Esophageal Squamous Cell Carcinoma," Biochem Biophys Res Commun 375(3):440-445, 2008.
Mintz P.J., et al., "Fingerprinting the Circulating Repertoire of Antibodies from Cancer Patients," Nat Biotechnol 21 (1):57-63, 2003.
Mirgorodskaya E., et al., "Partial Vapor-Phase Hydrolysis of Peptide Bonds: A Method for Mass Spectrometric Determination of O-Glycosylated Sites in Glycopeptides," Anal Biochem 269(1):54-65, 1999.
Nakamori S., et al., "MUC1 Mucin Expression as a Marker of Progression and Metastatis of Human Colorectal Carcinoma," Gastroenterology 106(2):353-361, 1994.
Napoletano C., et al., "Tumor-Associated Tn-MUC1 Glycoform is Internalized Through the Macrophage Galactose-Type C-Type Lectin and Delivered to the HLA Class I and II Compartments in Dendritic Cells," Cancer Res 67 (17):8358-8367, 2007.
Nolen B., et al., "Aberrant Tumor-Associated Antigen Autoantibody Profiles in Healthy Controls Detected by Multiplex Bead-Based Immunoassay," J Immunol Methods 344(2):116-120, 2009.
Ogata S., et al., "Tumor-associated Sialylated Antigens are Constitutively Expressed in Normal Human Colonic Mucosa," Cancer Res 55(9):1869-1874, 1995.
Pandey J.P., et al., "Immunoglobulin Allotypes Influence IgG Antibody Responses to Hepatitis C Virus Envelope Proteins E1 and E2," Hum Immunol 69(3):158-164, 2008.
Pereira-Faca S.R., et al., "Identification of 14-3-3 Theta as an Antigen that Induces a Humoral Response in Lung Cancer," Cancer Res 67(24):12000-12006, 2007.
Robbe-Masselot, et al., "Expression of a Core 3 Disialyl-Le(x) Hexasaccharide in Human Colorectal Cancers: A Potential Marker of Malignant Transformation in Colon," J. Proteom. Res. 8:702-711, 2009.
Sabbatini P.J., et al., "Pilot Study of a Heptavalent Vaccine-Keyhole Limpet Hemocyanin Conjugate Plus QS21 in Patients with Epithelial Ovarian, Fallopian Tube, or Peritoneal Cancer," Clin Cancer Res 13(14):4170-4177, 2007.
Scanlan M.J., et al., "Characterization of Human Colon Cancer Antigens Recognised by Autologous Antibodies," Int J Cancer 76(5):652-658, 1998.
Scian M. J., et al., "Wild-type p53 and p73 Negatively Regulate Expression of Proliferation Related Genes," Oncogene 27(18):2583-2593, 2008.
Selby J.V., et al., "A Case-control Study of Screening Sigmoidoscopy and Mortality from Colorectal Cancer," N Engl J Med 326(10):653-657, 1992.
Springer G.F., "T and Tn, General Carcinoma Autoantigens," Science 224(4654):1198-1206, 1984.
Stockert E., et al., "A Survey of the Humoral Immune Response of Cancer Patients to a Panel of Human Tumor Antigens," J Exp Med 187(8):1349-1354, 1998.
Sugita Y., et al., "NY-ESO-1 Expression and Immunogenecity in Malignant and Benign Breast Tumors," Cancer Res 64(6):2199-2204, 2004.
Svane I.M., et al., "Vaccination with p53-peptide-pulsed Dendritic Cells, of Patients with Advanced Breast Cancer: Report from a Phase I Study," Cancer Immunol Ummunother 53(7):633-641, 2004.
Sørensen A.L., et al., "Chemoenzymatically Synthesized Multimeric Tn/STn MUC1 Glycopeptides Elicit Cancer-specific Anti-MUC1 Antibody Responses and Override Tolerance," Glycobiology 16(2):96-107, 2006.
Tarp M.A., et al., "Identification of a Novel Cancer-specific Immunodominant Glycopeptide Epitope in the MUC1 Tandem Repeat," Glycobiology 17(2):197-209, 2007.
Tinder T.L., et al., "MUC1 Enhances Tumor Progression and Contributes Toward Immunosuppression in a Mouse Model of Spontaneous Pancreatic Adenocarcinoma," J Immunol 181(5):3116-3125, 2008.
Van Kooyk Y., "C-type Lectins on Dendritic Cells: Key Modulators for the Induction of Immune Responses," Biochem Soc Trans 36(Pt 6):1478-1481, 2008.
Van Vliet S.J., et al., "Carbohydrate Profiling Reveals a Distinctive Role for the C-type Lectin MGL in the Recognition of Helminth Parasites and Tumor Antigens by Dendritic Cells," Int. Immunol 17(5):661-669, 2005.
Vogelstein B., et al., "Genetic Alterations During Colorectal-tumor Development," N Engl J Med 319(9):525-532, 1988.
Von Mensdorff-Pouilly S., et al., "Reactivity of Natural and Induced Human Antibodies to MUC1 Mucin with MUC1 Peptides and N-acetylgalactosamine (GalNAc) Peptides," Int J Cancer 86(5):702-712, 2000.
Wandall H.H., et al., "The Lectin Domains of Polypeptide GalNAc-Transferases Exhibit Carbohydrate-binding Specificity for GalNAc: Lectin Binding to GalNAc-Glycopeptide Substrates is Required for High Density GalNAc-O-Glycosylation," Glycobiology 17(4):374-387, 2007.
Wandall H.H., et al., "Cancer Biomarkers Defined by Autoantibody Signatures to Aberant O-Glycopeptide Epitopes," Cancer Res. 70(4):1306-1313, 2010.
Whitlock E.P., et al., "Screening for Colorectal Cancer: A Targeted, Updated Systematic Review for the US Preventive Services Task Force," Ann Intern Med 149(9):638-658, 2008.
Zhang S., et al., "Immune Sera and Monoclonal Antibodies Define Two Configurations for the Sialyl Tn Tumor Antigen," Cancer Res 55(15):3364-3368, 1995.

* cited by examiner

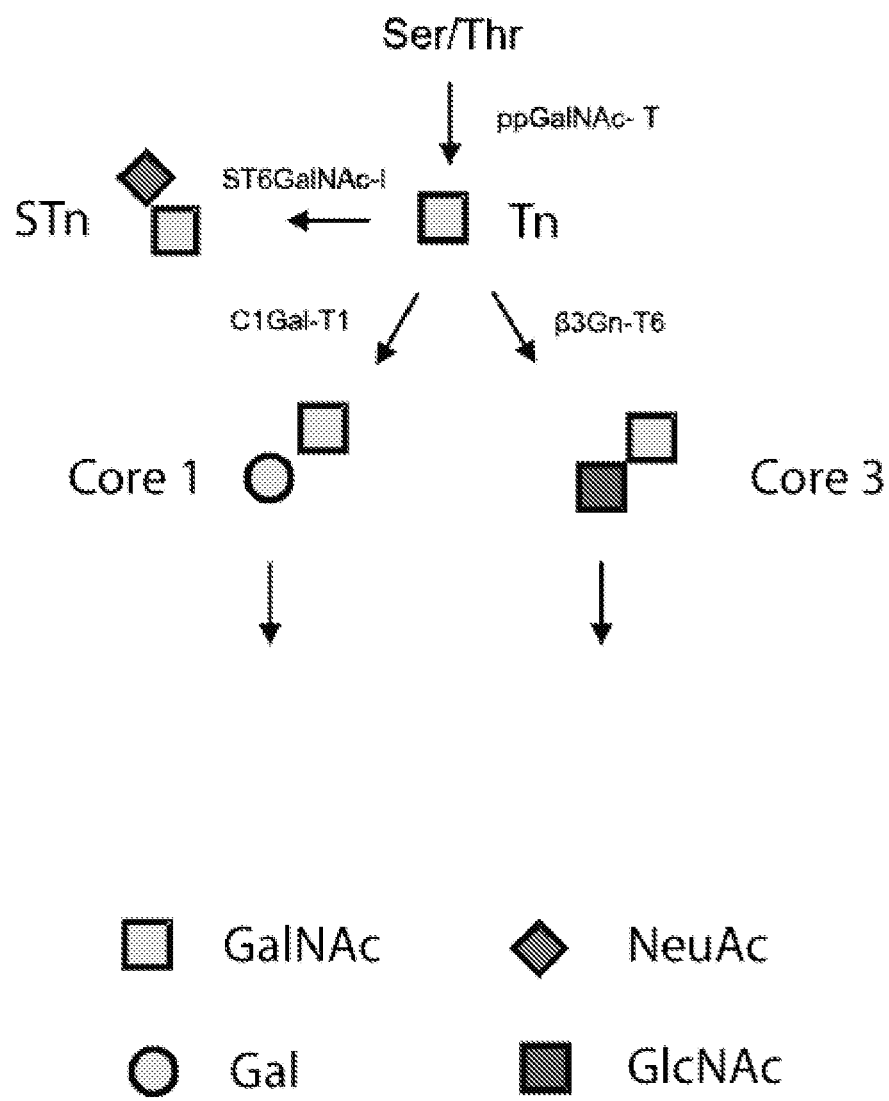

Fig 1C

MUC1 MAb 5E10

Tn (GalNAcα- S/T) MAb 1E3

STn (NeuAcα2,6GalNAc-S/T) MAb 3F1

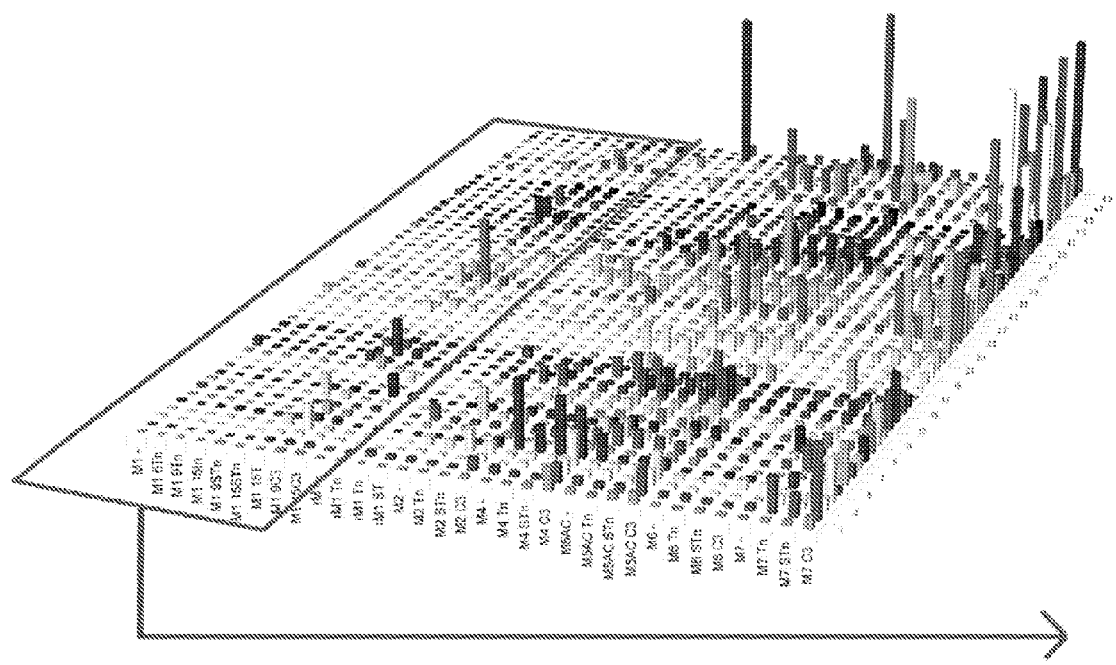
Fig 2A  Healthy controls

Inflammatory Bowel Disease

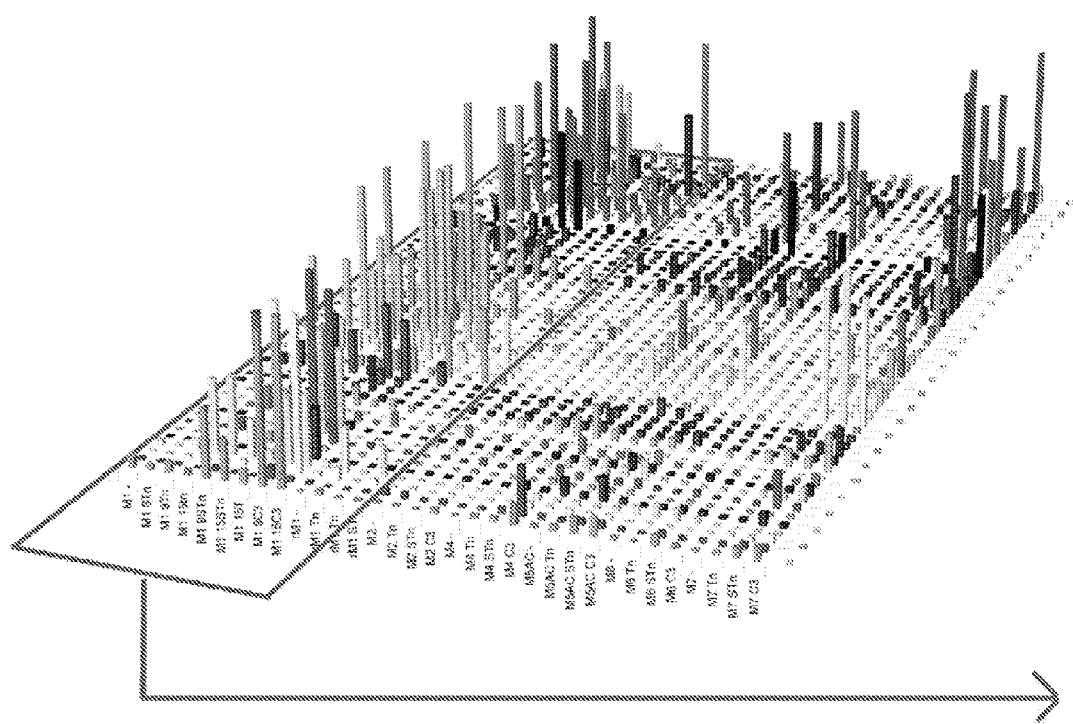
Fig 2C Colorectal cancer

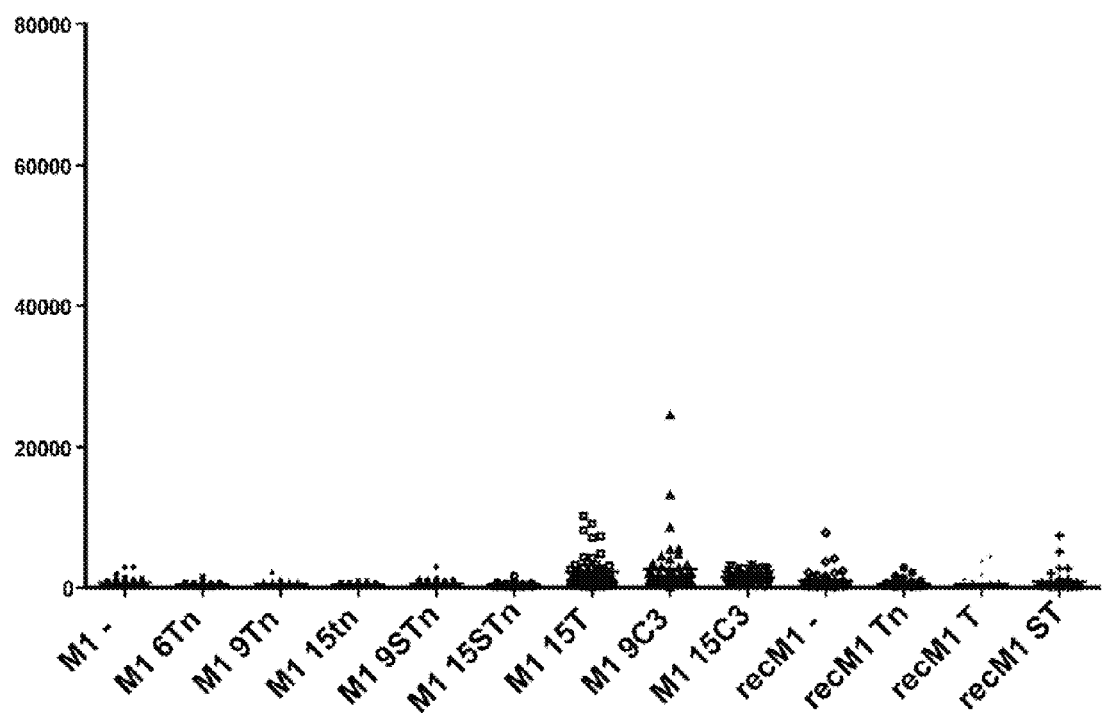

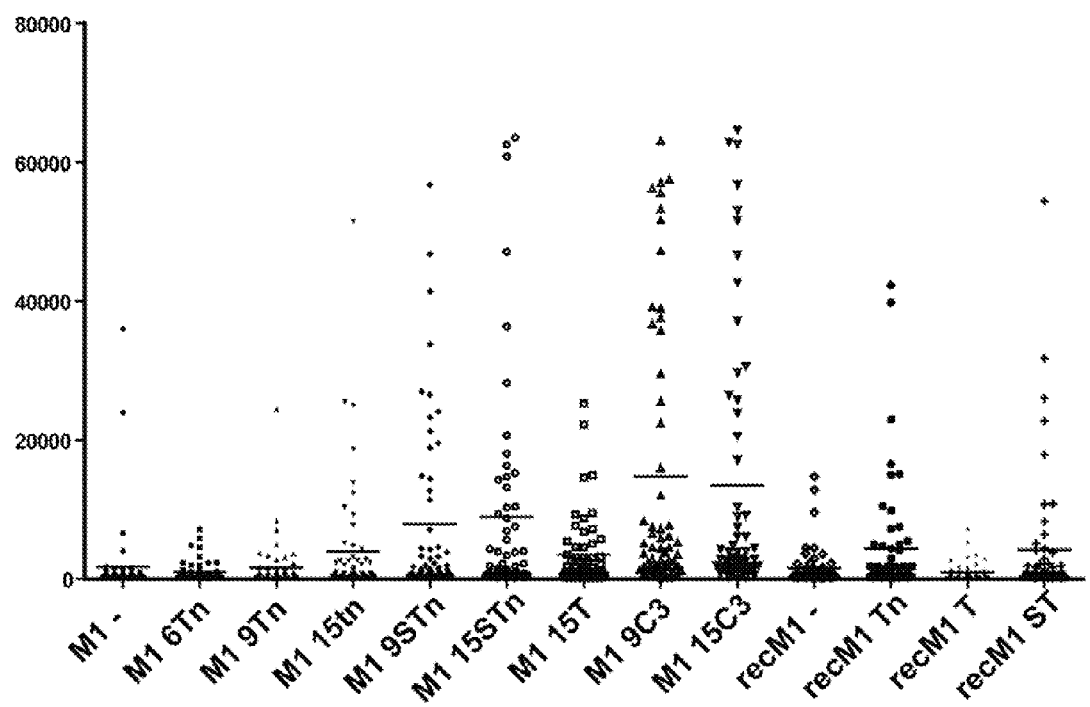
Fig 2F  Colorectal Cancer

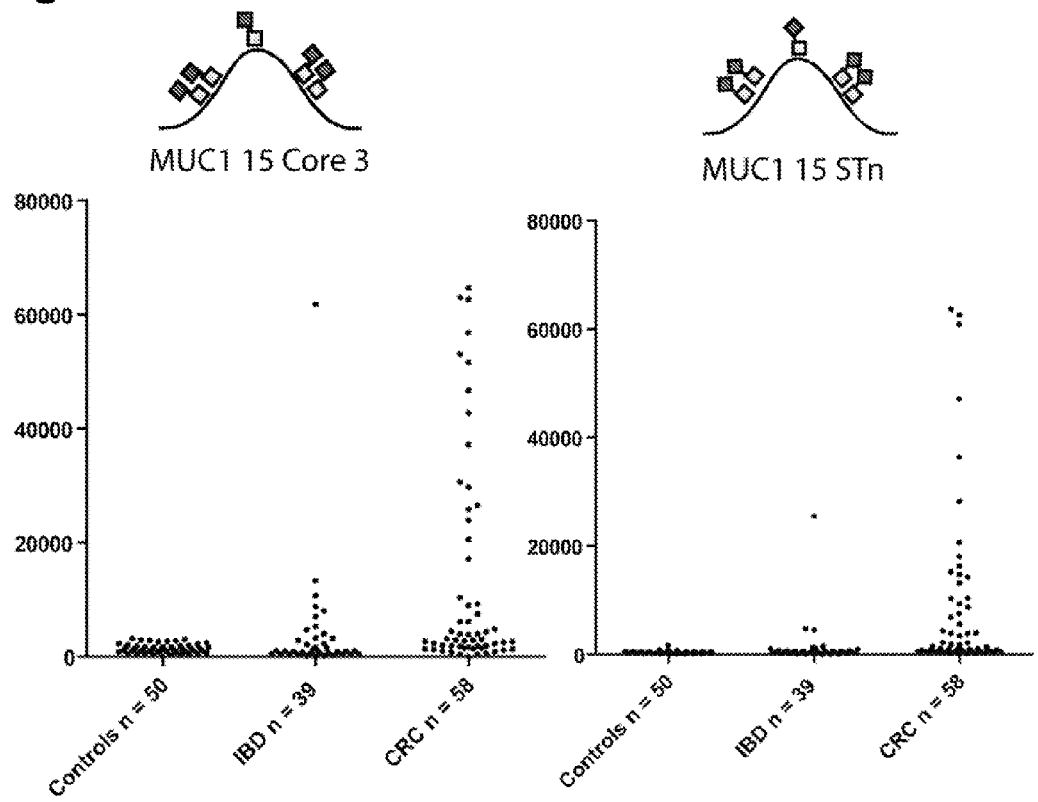

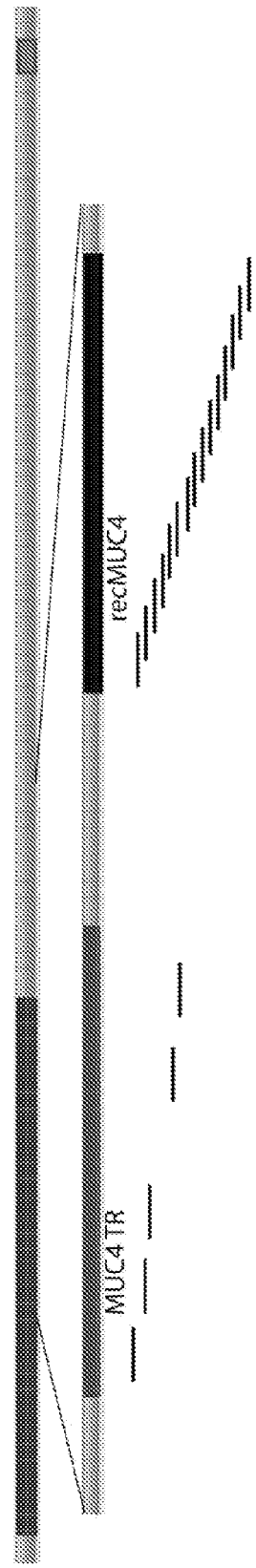

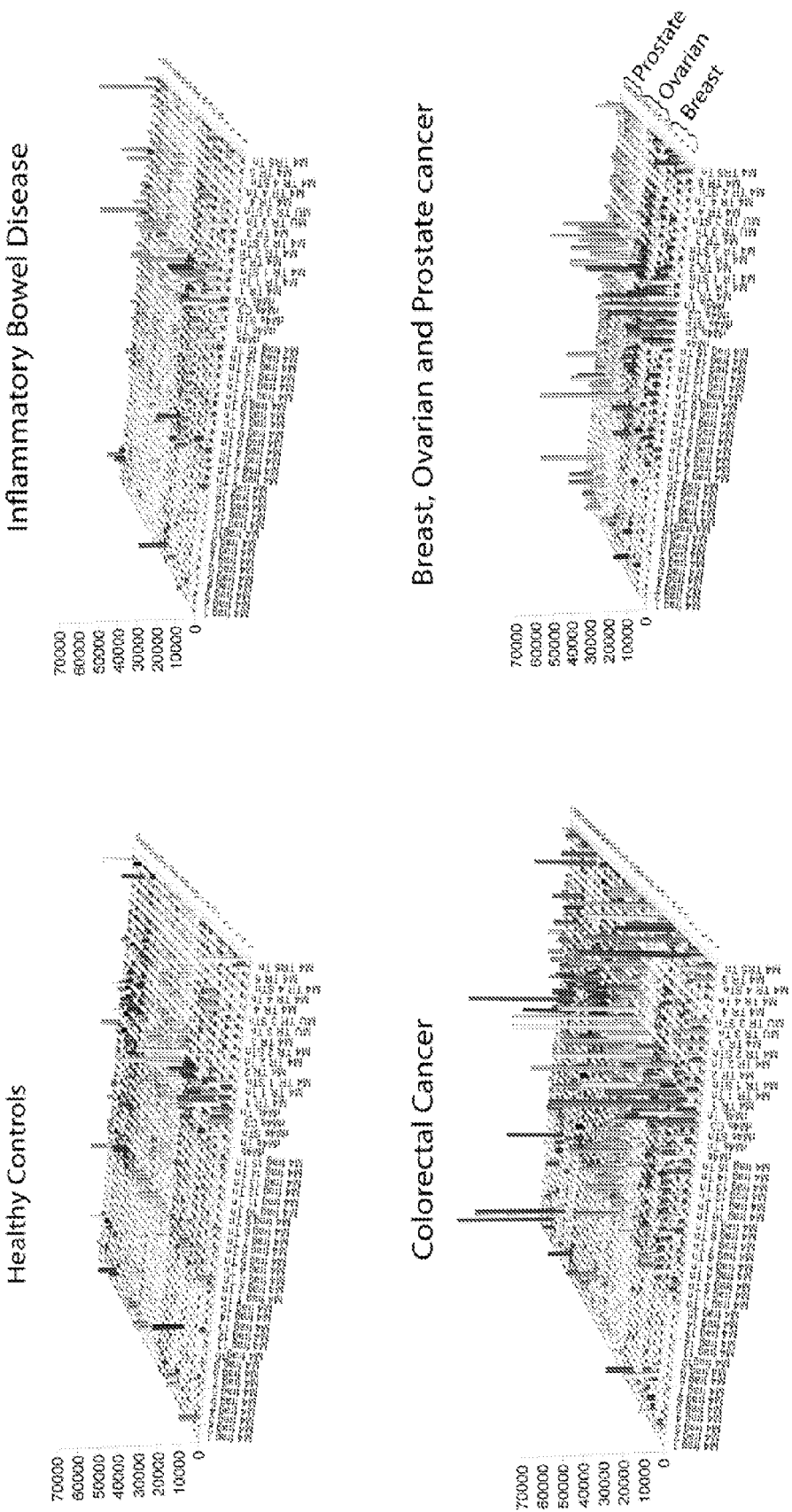

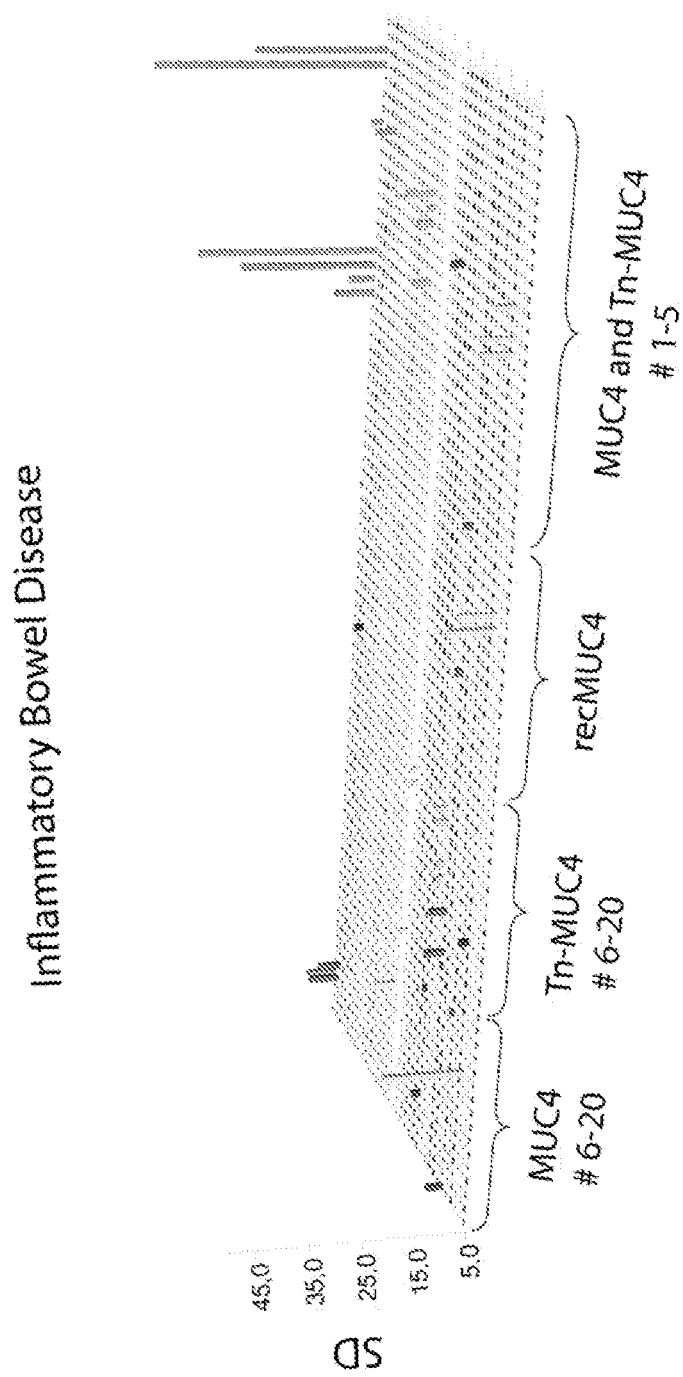
Fig. 4C, cont

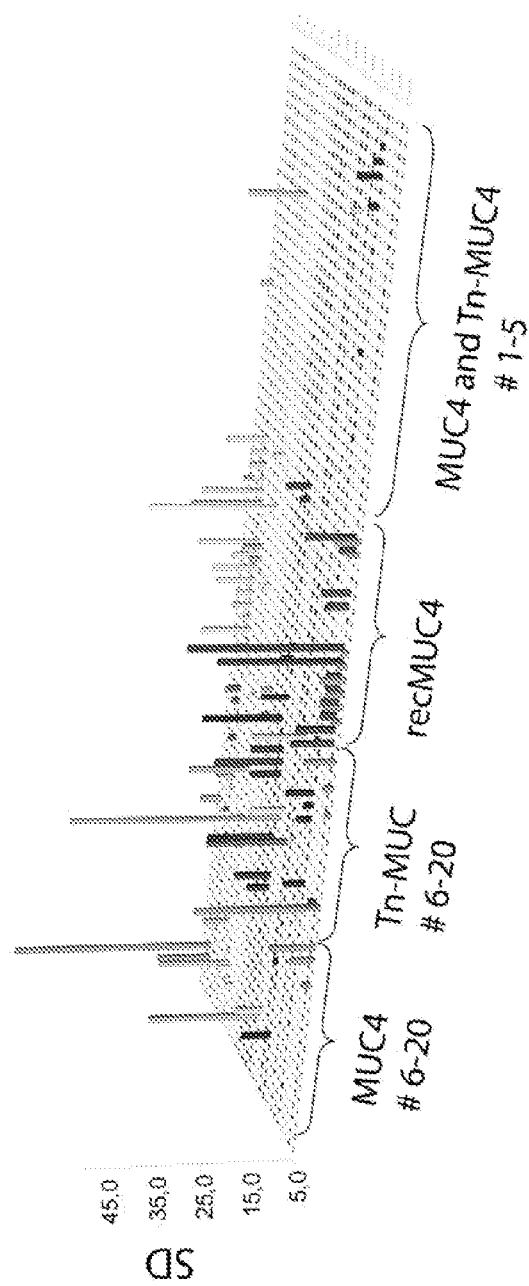
Fig. 4C, cont

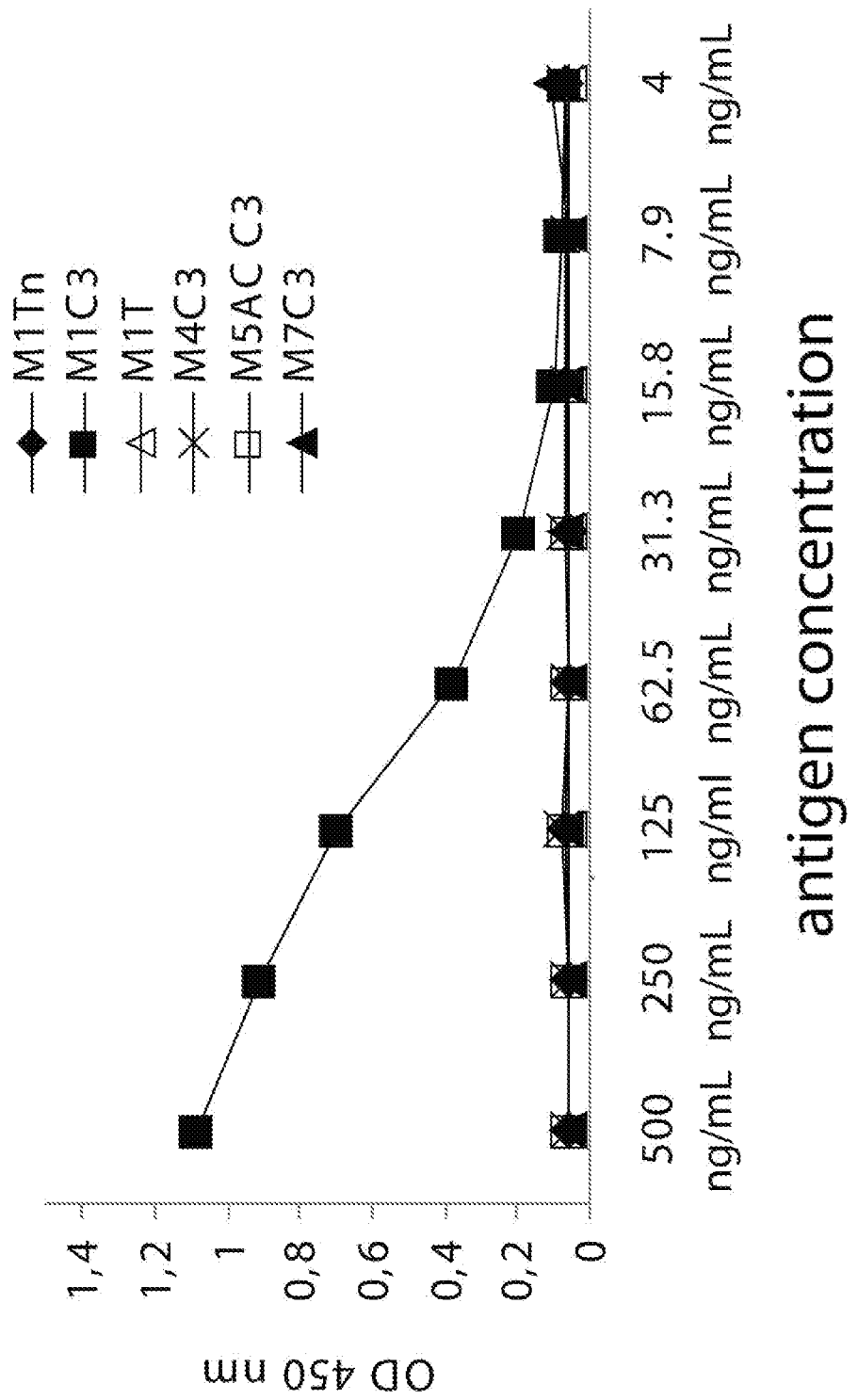

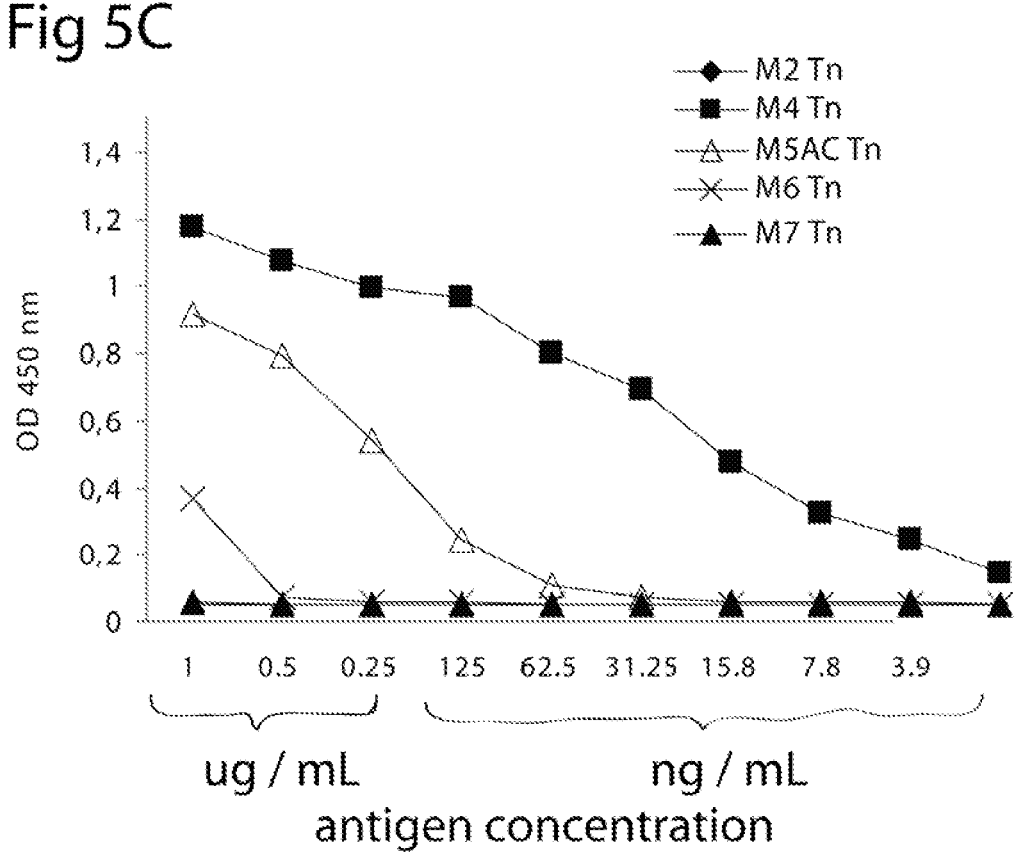

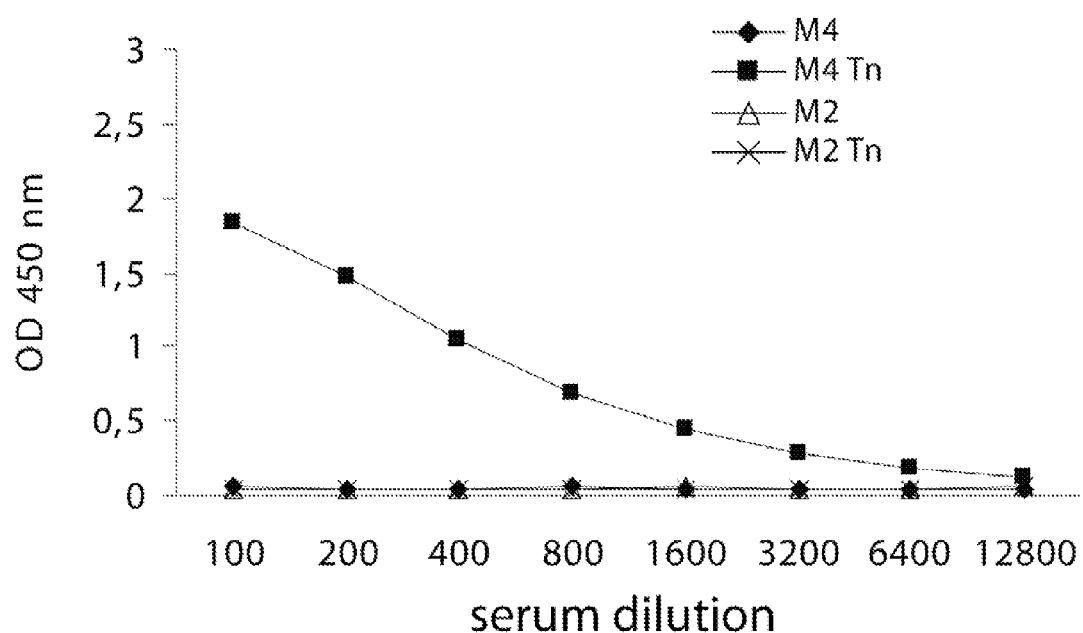

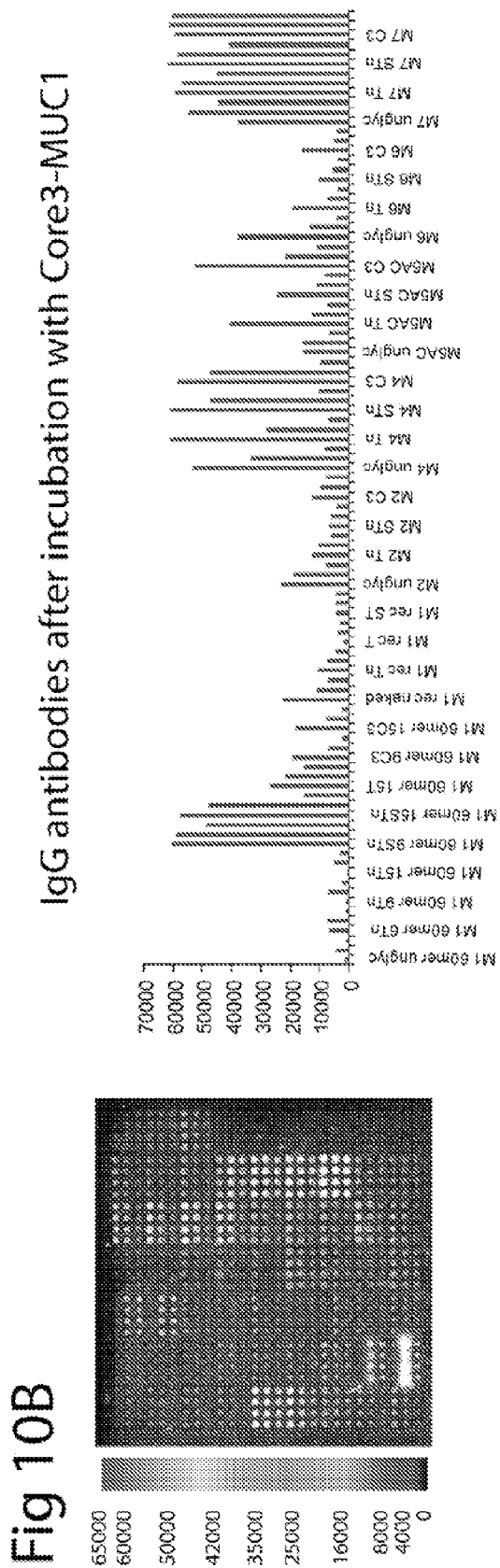

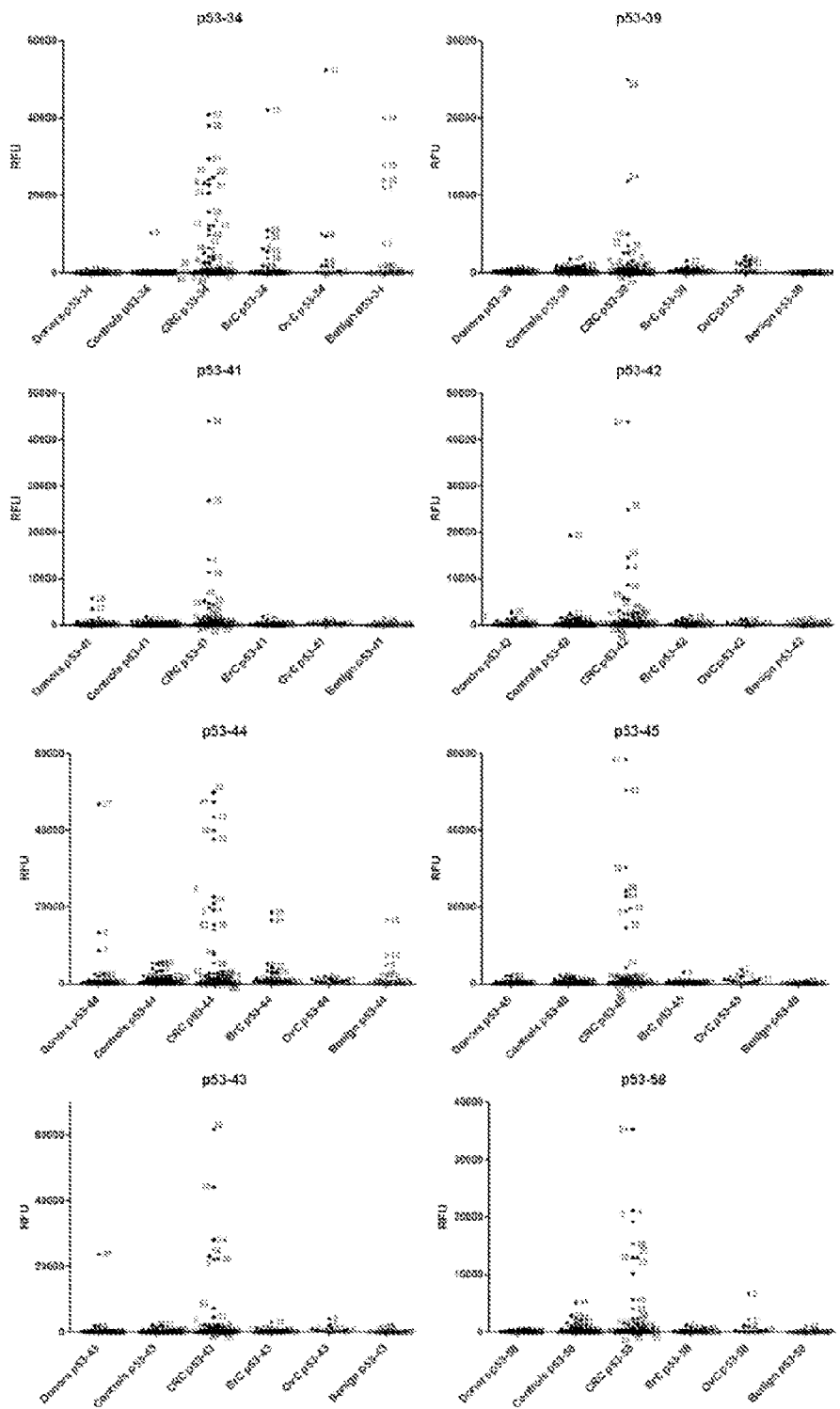
Fig. 15, cont

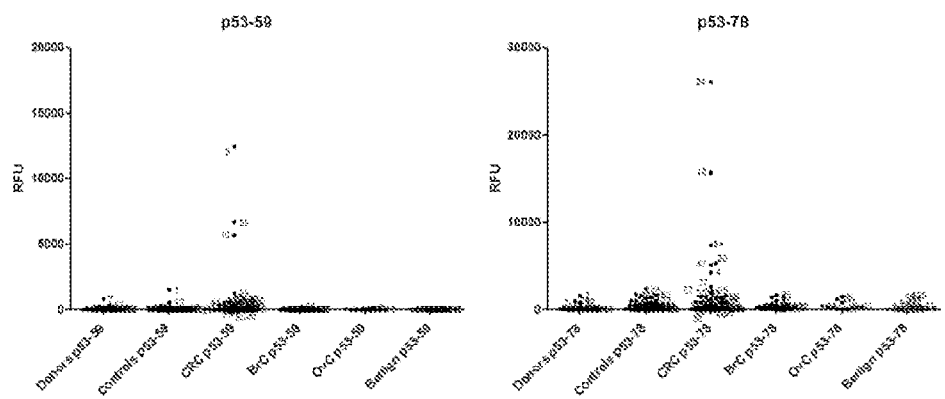
Fig. 15, cont

METHOD FOR EARLY DETECTION OF CANCER

All patent and non-patent references cited in the present application are hereby incorporated by reference in their entirety.

FIELD OF INVENTION

The present invention relates to methods for detecting and treating cancer using multiple O-glycosylated mucin peptides, fragments and variants, in addition to antibodies binding to said glycosylated peptides. In particular the invention relates to a method of detecting cancer, including but not limited to colorectal cancer, pancreatic cancer, breast cancer, oral cancer, gastric cancer, esophageal cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

INCORPORATION-BY-REFERENCE OF SEQUENCE LISTING

A sequence listing, created as the ASCII text file "5211-0003-US_Seq_Listing.txt" having a file size of 664 kilobytes, is incorporated herein by reference in its entirety.

BACKGROUND OF INVENTION

Colorectal cancer develops in a multistep process that arises from genetic or epigenetic alterations (Vogelstein, Fearon et al. 1988). Most colorectal cancers can be treated by removal of early malignant lesions (Selby, Friedman et al. 1992; Etzioni, Urban et al. 2003), but despite this colorectal cancer remains the second most common cause of cancer death in the United States (Jemal, Murray et al. 2005; Hospital 2006). Current screening techniques include fecal occult blood, double contrast barium enema, sigmoid- and colonoscopy, as well as computed tomographic colonography (Whitlock, Lin et al. 2008). Although these procedures are important in the early detection of colorectal cancer with significant impact on mortality, they are complicated with low compliance and high cost (Ahlquist, Sargent et al. 2008; Whitlock, Lin et al. 2008). With the aim of facilitating surveillance and identification of high-risk populations, genomics and proteomics have elucidated many new potential biomarkers (Garcea, Sharma et al. 2003). Such efforts to develop a simple reliable non-invasive screening test for early detection of colorectal cancer had thus far been unsuccessful, mostly because their use in clinical practice has been hampered by lack of specificity and sensitivity (Kim, Yu et al. 2008). Thus, new biomarkers for the early detection of colorectal cancer are needed.

Circulating auto-antibodies serve as serological biomarkers with long circulation time. They are the result of the inherent amplified function of the immune system mirroring cancer specific structures not governed by self-tolerance (Anderson and LaBaer 2005). Several methodologies have been used to detect such auto-antibodies to cancer associated antigens (Stockert, Jager et al. 1998; Pereira-Faca, Kuick et al. 2007) (Mintz, Kim et al. 2003), (Chen, Scanlan et al. 1997; Stockert, Jager et al. 1998; Jager, Stockert et al. 1999; Sugita, Wada et al. 2004), (Scanlan, Chen et al. 1998; Scian, Carchman et al. 2008) (Liu, Zhang et al. 2008). None of these technologies take post-translational modifications into account.

WO 2008/040362 (Clausen et al) discloses a number of glycosylation patterns of the MUC1 peptide VTSAPDTR-PAPGSTAPPAHG but does not provide any hint as to the connection between the Core3 glycan (GlcNAcβ1-3Gal-NAc-α-Ser/Thr) in relation to detecting cancer.

U.S. Pat. No. 6,465,220 (Hassan et al) discloses a method of glycosylating a MUC1 acceptor peptide, but does not provide any information as how to use these glycopeptides for detecting colorectal cancer.

WO 1999/034824 (Karsten et al) discloses a tumour vaccine based on a synthetic MUC1 derived peptide PDTR-PAP glycosylated on the Threonine residue.

US 2003 0232399 (Robertson et al) discloses a method of detecting the immune response of a mammal to circulating tumour marker proteins mainly associated with breast cancer, including MUC1, p53, c-erbB2, Ras, c-myc, BRCA1, BRCA2, PSA, APC and CA125. Robertson et al does not disclose the specific glycopeptides of the present invention or specific antibodies against these peptides.

US 2007 0240236 (Xia et al), also published as WO2008/147405, discloses use of an O-glycan composition (e.g., mucins) to prevent or treat inflammatory bowel diseases or gastrointestinal tumours. O-glycan compounds such as a mucin are proposed for the prevention and treatment of a gastrointestinal cancer, such as colorectal cancer. However, Xia et al does not provide any solution to how to diagnose cancer at an early stage by using the antibody-glycopeptide lock-and-key concept of the present invention.

WO 2006138275 (Wang et al) discloses compositions and methods for treating, characterizing and diagnosing cancer, including CRC but do not mention the specific glycopeptides of the present invention.

Robbe-Masselot et al. (2009) J. Proteome Res. 8(2):702-11 discusses expression of a core 3 disialyl-Le(x) hexasaccharide in human colorectal cancers as a potential marker of malignant transformation in colon. The findings of Robbe-Masselot et al. relates to MUC2. There is no disclosure in this paper of the specific glycopeptides or antibodies of the present invention.

Thus the current state of the art does not provide a solution to the need for new biomarkers for the early detection of cancer such as colorectal cancer.

SUMMARY OF INVENTION

As a solution to the need for biomarkers for the early detection of disease such as, but not limited to cancer the present inventors have found that specific changes in post-translational modifications, such as glycosylation pattern of the translated proteins are useful in detecting disease. In relation to cancer, these changes also provide recognizable patterns that, when suitably detected, can be used to discriminate between cancer and other diseases or disorders within the same tissue(s) and/or organ(s) that presents with the same or similar symptoms, for example colorectal cancer and inflammatory bowel disease of the gastrointestinal tract.

By combining at least two glycosylated peptides, such as O-glycosylated mucin it is possible at an early disease stage, to discriminate between autoantibodies resulting from cells suffering from different kinds of disorders and diseases. The method can also be reversed, by using an antibody to detect a glycosylated mucin peptide which may have been shed from a cell surface mucin as a consequence of disease in said cell. In this manner the antibody and the glycopeptide epitope may be considered as plug and socket.

Thus in a first aspect, the present invention relates to a method for detecting cancer, said method comprising (i) contacting a sample from a sample host with
  (a) at least two different mucin peptides,
    wherein said at least two different mucin peptides individually consists of an amino acid sequence comprising at least 5 consecutive amino acid residues, and
    wherein at least one of said at least 5 amino acid residues are Serine or Threonine, and
    wherein at least one of said Serine or Threonine residues is O-glycosylated by a glycan independently selected from the group consisting of:
    Core-3 (GlcNAcβ1-3GalNAc-α-Ser/Thr),
    Tn (GalNAc-α-Ser/Thr),
    STn/sialyl-Tn (Neu5Acα2-6GalNAc-α-Ser/Thr),
    Core-2 (Galβ1-3(GlcNAcβ1-6)GalNAc-α-Ser/Thr))
    Core-4 (GlcNAcβ1-3(GlcNAcβ1-6)GalNAc-α-Ser/Thr), and
    ST/sialyl-T (Neu5Acα2-3Galβ3GalNAc-Ser/Thr),
    or,
  (b) a monoclonal antibody, wherein said antibody is capable of recognising at least one of the O-glycosylated mucin peptides of (a), and
(ii) removing unbound sample, and
(iii) qualitatively and/or quantitatively characterising the bound material, wherein
  (a) antibodies or antigen binding fragments of antibodies, bound to said O-glycosylated peptides, or
  (b) O-glycosylated peptide bound to said antibody
  is indicative of cancer in the sample host.

The method is applicable both when using one or more peptides as well as two, three, four or more different O-glycosylated peptides for detecting autoantibodies specific to different peptides, or an antibody cross-reacting in a known manner with known O-glycosylated mucin peptides. The method has been demonstrated to be particularly useful in detecting colorectal cancer (CRC).

Thus, in another aspect, the present invention relates to a method for detecting colorectal cancer, said method comprising
(i) contacting a sample from a sample host with
  (a) one or more different mucin peptides,
    wherein said one or more different mucin peptides individually consists of an amino acid sequence comprising at least 5 consecutive amino acid residues, and
    wherein at least one of said at least 5 amino acid residues are Serine or Threonine, and
    wherein at least one of said Serine or Threonine residues is O-glycosylated by a glycan independently selected from the group consisting of:
    Core-3 (GlcNAcβ1-3GalNAc-α-Ser/Thr),
    Tn (GalNAc-α-Ser/Thr),
    STn/sialyl-Tn (Neu5Acα2-6GalNAc-α-Ser/Thr),
    Core-2 (Galβ1-3(GlcNAcβ1-6)GalNAc-α-Ser/Thr))
    Core-4 (GlcNAcβ1-3(GlcNAcβ1-6)GalNAc-α-Ser/Thr), and
    ST/sialyl-T (Neu5Acα2-3Galβ3GalNAc-Ser/Thr),
    or,
  (b) a monoclonal antibody, wherein said antibody is capable of recognising at least one of the O-glycosylated mucin peptides of (a), and
(ii) removing unbound sample, and
(iii) qualitatively and/or quantitatively characterising the bound material, wherein
  (a) antibodies or antigen binding fragments of antibodies, bound to said O-glycosylated peptides, or
  (b) O-glycosylated peptide bound to said antibody
  is indicative of colorectal cancer in the sample host.

In another aspect the invention relates to a method for detecting cancer, said method comprising
(i) contacting a sample from a sample host with
  (a) one or more different mucin peptides,
    wherein said one or more different mucin peptides individually consists of an amino acid sequence comprising at least 5 consecutive amino acid residues, and
    wherein at least one of said at least 5 amino acid residues are Serine or Threonine, and
    wherein at least one of said Serine or Threonine residues is O-glycosylated by a glycan independently selected from the group consisting of:
    Core-3 (GlcNAcβ1-3GalNAc-α-Ser/Thr),
    Tn (GalNAc-α-Ser/Thr),
    STn/sialyl-Tn (Neu5Acα2-6GalNAc-α-Ser/Thr),
    Core-2 (Galβ1-3(GlcNAcβ1-6)GalNAc-α-Ser/Thr))
    Core-4 (GlcNAcβ1-3(GlcNAcβ1-6)GalNAc-α-Ser/Thr), and
    ST/sialyl-T (Neu5Acα2-3Galβ3GalNAc-Ser/Thr),
    or,
  (b) a monoclonal antibody, wherein said antibody is capable of recognising at least one of the O-glycosylated mucin peptides of (a), and
(ii) removing unbound sample, and
(iii) qualitatively and/or quantitatively characterising the bound material, wherein
  (a) antibodies or antigen binding fragments of antibodies, bound to said O-glycosylated peptides, or
  (b) O-glycosylated peptide bound to said antibody
  is indicative of cancer in the sample host.

While the method described herein above is particularly useful in detecting cancer, it may in principle be used to detect any disease with a similar disease pattern.

Thus in a further aspect, the present invention relates to a method for detecting a disease in a sample host wherein said disease is characterised in that autoantibodies are produced by the individual suffering from the disease, said method comprising
(i) contacting a sample from said sample host with
  (a) at least two different mucin peptides,
    wherein said at least two different mucin peptides individually consists of an amino acid sequence comprising at least 5 consecutive amino acid residues, and
    wherein at least one of said at least 5 amino acid residues are Serine or Threonine, and
    wherein at least one of said Serine or Threonine residues is O-glycosylated by a glycan independently selected from the group consisting of:
    Core-3 (GlcNAcβ1-3GalNAc-α-Ser/Thr),
    Tn (GalNAc-α-Ser/Thr),
    STn/sialyl-Tn (Neu5Acα2-6GalNAc-α-Ser/Thr),
    Core-2 (Galβ1-3(GlcNAcβ1-6)GalNAc-α-Ser/Thr))
    Core-4 (GlcNAcβ1-3(GlcNAcβ1-6)GalNAc-α-Ser/Thr), and
    ST/sialyl-T (Neu5Acα2-3Galβ3GalNAc-Ser/Thr),
    or,
  (b) a monoclonal antibody, wherein said antibody is capable of recognising at least one of the O-glycosylated mucin peptides of (a), and
(ii) removing unbound sample, and (iii) qualitatively and/or quantitatively characterising the bound material, wherein
(a) antibodies or antigen binding fragments of antibodies, bound to said O-glycosylated peptides, or
(b) O-glycosylated peptide bound to said antibody
is indicative of disease in the sample host.

An object of the present invention is to use the general method defined above for detecting specific disorders characterised in that autoantibodies are produced by the individual suffering from said disease. One such disease is cancer. An individual afflicted with cancer significantly benefits from an early stage diagnosis. Accordingly, in one aspect the present invention relates to a method for detecting cancer, said method comprising
(i) contacting a sample with one or more O-glycosylated mucin peptides, wherein said peptide is selected from the group consisting of:
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17),
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23), VT*S*APDT*RPAPGS*T*APPAHG (SEQ ID NO: 24), PT*T*T*PIT*T*T*T*T*VT*PT*PT*PT*GT*QT*PT*T* T*PIS*T*T*C (SEQ ID NO: 25) and PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), or a fragment of said peptides, or variants of said peptides in which variants any amino acid has been changed to a different amino acid, provided that no more than 5 of the amino acid residues in the sequence are so changed, and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6) GalNAc-α-Ser/Thr), and ST/sialyl-T (Neu5Acα2-3Galβ3GalNAc-Ser/Thr) and
(ii) removing unbound sample, and (iii) qualitatively and/or quantitatively characterise the bound material, wherein antibodies bound to said peptides indicate cancer in the sample host.

In a further aspect the present invention concerns a method for detecting cancer, said method comprising
(i) contacting a sample with one or more mucin peptides, wherein said peptide is selected from the group consisting of:
a) MUC4 Tn selected from the group consisting of PVT*S*PS*S*AS*T*GHT*T*PLPVT*DT*S*S*AS*T* GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T* GHAT* (SEQ ID NO: 23), wherein the asterisk (*) indicates a potential O-glycosylation site, wherein the optional glycan is Tn (GalNAc-α-Ser/Thr), or
b) a MUC4 non glycosylated mucin peptide selected from the group consisting of
PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSAS-TGQ (SEQ ID NO: 20), PLPVTSPSSASTGHASPLLVT-DASSASTGQ (SEQ ID NO: 21) STGDTLPLPVTDTSSV (SEQ ID NO: 22), PVTYASSASTGDTTPLPVTDTSSVST-GHAT (SEQ ID NO: 23), or a Tn glycosylated mucin peptide selected from the group consisting of PVT*S*PS*S*AS*T*GHT*T*PLPVT*DT*S*S*AS*T* GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T* GHAT* (SEQ ID NO: 22), wherein the asterisk (*) indicates a potential O-glycosylation site, wherein the optional glycan is Tn (GalNAc-α-Ser/Thr), or
c) a Tn glycosylated MUC4 peptide selected from the group consisting of
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID15 NO: 15), S*GS*EGIS*T*S*GET*T*RFS*S*N (SEQ ID NO: 16) and GET*T*RFS*S*NPS*RDS*HT*T* (SEQ ID NO: 17), wherein the asterisk (*) indicates a potential O-glycosylation site, wherein the optional glycan is Tn (GalNAc-α-Ser/Thr), or d) an all-Tn MUC4 peptide selected from the group consisting of
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) and
PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEGQWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30),
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD (SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates an O-glycosylation site, wherein the glycan is Tn (GalNAc-α-Ser/Thr), or
e) a recombinant MUC4 Tn having the sequence PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEGQWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the optional glycan is Tn (GalNAc-α-Ser/Thr), or
f) a MUC1Tn/STn/Core3 glycosylated or MUC4 Tn glycosylated mucin peptide selected from the group consisting of VT(Tn)S(Tn)APDT(Tn)RPAPGS(Tn)T(Tn)APPAHG, VT(STn)S(STn)APDT(STn)RPAPGS(STn)T(STn)APPAHG, VT(Core3)S(Core3)APDT(Core3)RPAPGS(Core3)T(Core3)APPAHG,
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD (SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23),
and
PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEGQWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30),
wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), or g) a MUC1 STn and a MUC4 selected from the group consisting of
VT(STn)S(STn)APDT(STn)RPAPGS(STn)T(STn)APPAHG,
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and (ii) removing unbound sample, and (iii) qualitatively and/or quantitatively characterise the bound material, wherein antibodies bound to said peptides indicate cancer in the sample host.

The peptides of the invention may be produced either by digesting full length or truncated mucin polypeptides or by automated peptide synthesis and optionally glycosylated as described herin below. These methods for peptide synthesis and glycosylation are known to those skilled in the art.

In principle the present invention is applicable to any glycosylated peptide epitope and a corresponding antibody, acting in a lock and key-manner, for the detection of various disorders and diseases. The present inventors have found that the efficiency of detection is particularly good when two or more different glycosylated peptides are used for the detection of disease. Thus, in one aspect the invention relates to a method for detecting a disease in an individual wherein said disease is characterised in that autoantibodies are produced by the individual suffering from the disease, said method comprising
(i) contacting a sample with at least two glycosylated peptides, and
(ii) removing unbound sample, and
(iii) qualitatively and/or quantitatively characterise the bound material, wherein antibodies bound to said peptides are indicative of disease or disorder in the sample host.

While the present invention is applicable to any optionally glycosylated peptide and a corresponding antibody, for the detection of various disorders and diseases, the present inventors have also identified a number of specific mucin based peptides that are useful in detecting colorectal cancer.

Accordingly, in a further aspect, the present invention relates to a method for detecting colorectal cancer in a host organism, said method comprising
(i) contacting a sample from said host organism with one or more O-glycosylated mucin peptides, wherein said peptide(s) is/are selected from the group consisting of: PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23), VT*S*APDT*RPAPGS*T*APPAHG (SEQ ID NO: 24), PT*T*T*PIT*T*T*T*T*VT*PT*PT*PT*GT*QT*PT*T*T*PIS*T*T*C (SEQ ID NO: 25) and PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), or a fragment of said peptides, or variants of said peptides in which variants any amino acid has been changed to a different amino acid, provided that no more than 5 of the amino acid residues in the sequence are so changed, and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr), and ST/sialyl-T (Neu5Acα2-3Galβ3GalNAc-Ser/Thr), and
(ii) removing unbound sample, and
(iii) qualitatively and/or quantitatively characterise the bound material, wherein antibodies bound to said peptides indicate cancer in the sample host.

As demonstrated in table II of the present application, and as discussed herein above, it may be useful to utilise one or more, such as two different O-glycosylated peptides for detecting colorectal cancer, and for distinguishing between colorectal cancer and inflammatory bowel disease.

Thus, in one aspect the present invention relates to a method for detecting colorectal cancer in a sample host, said method comprising
(i) contacting a sample from said sample host with one or more mucin peptides, wherein said peptide is selected from the group consisting of:
a) MUC4 Tn selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), wherein the asterisk (*) indicates a potential O-glycosylation site, wherein the optional glycan is Tn (GalNAc-α-Ser/Thr), or
b) a MUC4 non glycosylated mucin peptide selected from the group consisting of PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSAS-TGQ (SEQ ID NO: 20), PLPVTSPSSASTGHASPLLVT-DASSASTGQ (SEQ ID NO: 21) STGDTLPLPVTDTSSV (SEQ ID NO: 22), PVTYASSASTGDTTPLPVTDTSSVST-GHAT (SEQ ID NO: 23), or a MUC4 Tn glycosylated mucin peptide selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 22), wherein the asterisk (*) indicates a potential O-glycosylation site, wherein the optional glycan is Tn (GalNAc-α-Ser/Thr), or
c) a Tn glycosylated MUC4 peptide selected from the group consisting of
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID15 NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates a potential O-glycosylation site, wherein the optional glycan is Tn (GalNAc-α-Ser/Thr), or d) an all-Tn MUC4 peptide selected from the group consisting of
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), wherein the asterisk (*) indicates an O-glycosylation site, wherein the glycan is Tn (GalNAc-α-Ser/Thr), or e) a recombinant MUC4 Tn having the sequence
PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the optional glycan is Tn (GalNAc-α-Ser/Thr), or f) a MUC1Tn/STn/Core3 glycosylated or MUC4 glycosylated mucin peptide selected from the group consisting of VT(Tn)S(Tn)APDT(Tn)RPAPGS(Tn)T(Tn)APPAHG, VT(STn)S(STn)APDT(STn)RPAPGS(STn)T(STn) APPAHG, VT(Core3)S(Core3)APDT(Core3)RPAPGS (Core3)T(Core3)APPAHG, PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23), and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr), and ST/sialyl-T (Neu5Acα2-3Galβ3GalNAc-Ser/Thr), or g) a MUC1 STn and a MUC4 selected from the group consisting of
VT(STn)S(STn)APDT(STn)RPAPGS(STn)T(STn) APPAHG, PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and (ii) removing unbound sample, and
(iii) qualitatively and/or quantitatively characterise the bound material, wherein antibodies bound to said peptides indicate cancer in the sample host.

In principle, any suitable O-glycosylated peptide can be used for detecting autoantibodies binding to this glycosylated peptide epitope. It is preferred that the peptide epitope comprises at least 5 amino acid residues.

Thus, in one aspect the invention relates to a method for detecting colorectal cancer in a host organism, said method comprising
(i) contacting a sample from said host organism with at least two different O-glycosylated peptides, and
(ii) removing unbound sample, and
(iii) qualitatively and/or quantitatively characterise the bound material, wherein antibodies bound to the peptides of step (i) are indicative of disease or disorder in the host organism.

In one aspect the present invention thus relates to a method for detecting colorectal cancer in a host organism, said method comprising
(i) contacting a sample from said host organism with one or more O-glycosylated peptides, wherein said peptide comprises at least 5 consecutive amino acid residues of a mucin selected from the group consisting of MUC4 (SEQ ID NO: 1), MUC1 (SEQ ID NO: 2), MUC1 Variant CT58, MUC1 Variant CT80, MUC1 Variant SEC, MUC1 Variant X, MUC1 Variant Y, MUC1 Variant ZD, MUC2 (SEQ ID NO: 26), MUC3A, MUC3B, MUC4, MUC5AC (SEQ ID NO: 27), MUC5B, MUC6 (SEQ ID NO: 28), and MUC7 (SEQ ID NO: 29), MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin, or a naturally occurring fragment or variant of said mucin, wherein said variant is at least 70% identical to said at least 5 consecutive amino acid residues of said mucin, and
(ii) removing unbound sample, and
(iii) qualitatively and/or quantitatively characterise the bound material, wherein antibodies bound to said peptides indicate cancer in the sample host.

The peptide can be any peptide sharing a significant sequence identity with the peptides specified herein above, or a peptide sharing secondary or tertiary structure with the present peptides. Thus, in a further aspect the present invention relates to a method for detecting colorectal cancer in a host organism, said method comprising
(i) contacting a sample from said host organism with one or more O-glycosylated mucin peptides, wherein said peptide comprises, or said peptides comprise, at least 5 consecutive amino acid residues of a mucin, or a fragment or variant thereof, wherein said variant is at least 70% identical, such as at least 75% identical to, e.g. at least 80% identical to, such as at least 85% identical to, e.g. at least 90% identical to, such as at least 95% identical to, e.g. at least 98% identical to, such as at least 99% identical to said at least 5 consecutive amino acid residues of said mucin, and
(ii) removing unbound sample, and
(iii) qualitatively and/or quantitatively characterise the bound material, wherein antibodies bound to said peptides indicate cancer in the host organism.

The MUC1 peptides of the invention have been found to be useful in detecting disease, and in particular colorectal cancer. Thus in one aspect the invention relates to a method for detecting colorectal cancer, said method comprising
(i) contacting a sample with one or more O-glycosylated MUC1 peptides and optionally at least one second mucin peptide wherein the O-glycosylated MUC1 peptides are selected from the group consisting of VTSAPDT(Core3) RPAPGSTAPPAHG (MUC1 Core3), VT(Core3)SAPDTR-PAPGS(Core3)T(Core3)APPAHG (MUC1 9Core3), VT(Core3)S(Core3)APDT(Core3)RPAPGS(Core3)T (Core3)APPAHG (MUC1-15Core3), VT(STn)S(STn) APDT(STn)RPAPGS(STn)T(STn)APPAHG (MUC 1 (15STn), VT(STn)SAPDTRPAPGS(STn)T(STn)APPAHG (MUC1 9STn), VT(Tn)S(Tn)APDT(Tn)RPAPGS(Tn)T(Tn) APPAHG (MUC1 15Tn), VT(Tn)SAPDTRPAPGS(Tn)T (Tn)APPAHG (MUC1 9Tn), VT(Tn)SAPDTRPAPGST(Tn) APPAHG (MUC1 6Tn) and wherein said at least one second mucin peptide optionally is/are selected from the group consisting of:
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S* AS*T*GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23) and PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is independently selected from the group consisting of Core-4 (GlcNAcβ1-3 (GlcNAcβ1-6)GalNAc-α-Ser/Thr), and ST/sialyl-T (Neu5Acα2-3Galβ3GalNAc-Ser/Thr) and
(ii) removing unbound sample, and
(iii) qualitatively and/or quantitatively characterise the bound material, wherein antibodies bound to said peptides indicate cancer in the sample host.

As discussed above, the method requires both parts of the lock-and-key mechanism to be present. The method thus also relates to use of the antibodies of the invention to detect glycopeptides epitopes binding to said antibodies.

Thus in another aspect, the present invention relates to a method for detecting cancer, said method comprising
(i) contacting a sample with an antibody capable of recognising one or more O-glycosylated mucin peptides, wherein said peptide comprises at least 5 consecutive amino acid residues of a mucin, or a fragment or variant thereof, wherein said variant is at least 70% identical, such as at least 75% identical to, e.g. at least 80% identical to, such as at least 85% identical to, e.g. at least 90% identical to, such as at least 95% identical to, e.g. at least 98% identical to, such as at least 99% identical to said at least 5 consecutive amino acid residues of said mucin, and (ii) removing unbound sample and/or unbound antibody and/or unbound antibody, and (iii) qualitatively and/or quantitatively characterise the bound material, wherein peptides bound to said antibodies indicate cancer in the sample host.

As with the peptides defined herein above, also the antibodies of the present invention may be used for detecting a disease associated with shedding of antibody target epitopes such as peptides. Therefore, in one aspect, the present invention also relates to a method for detecting a gastrointestinal disease in a host organism wherein said disease is characterised in that O-glycosylated mucin peptides are shed from the diseased host and secreted in the gastrointestinal tract of the sample organism suffering from the disease, said method comprising (i) contacting a sample from said host organism with one or more antibodies capable of recognising said O-glycosylated mucin peptides, and (ii) removing unbound sample, and (iii) qualitatively and/or quantitatively characterise the bound material, wherein peptides bound to the antibodies of step (i) are indicative of disease or disorder in the host organism.

In another aspect the invention relates to a method for detecting a disease such as a gastrointestinal disease, in a host organism wherein said disease is characterised in that O-glycosylated mucin peptides are shed from the diseased cells of the host into an extracellular volume, such as secreted into, the lumen of the bladder, milk ducts of the breast, lumen of the uterus, the vagina, into pancreatic fluid, into ascites fluid, onto bronchiolar surface of the lung, ductal surfaces of the prostate, lumen of the seminiferous tubules, the oesophagus or the gastrointestinal tract of the sample organism suffering from the disease, said method comprising (i) contacting a sample from said host organism with one or more antibodies capable of recognising said O-glycosylated mucin peptides, and (ii) removing unbound sample, and (iii) qualitatively and/or quantitatively characterise the bound material, wherein peptides bound to the antibodies of step (i) are indicative of disease or disorder in the host organism.

The present inventors have found glycopeptide epitopes associated with colorectal cancer and antibodies useful in detecting said glycopeptides. Therefore, in a further aspect, the present invention relates to a method for detecting colorectal cancer, said method comprising (i) contacting a sample with at least one antibody, wherein said antibody is capable of recognising a glycosylated mucin peptide selected from the group consisting of PMTDTKTVTTPGSSFTA (SEQ ID NO: 3), PGSSFTAS-GHSPSEIVPQD (SEQ ID NO: 4), SEIVPQDAPTISAAT-TFAPA (SEQ ID NO: 5), TTFAPAPTGNGHTTQAPTTA (SEQ ID NO: 6), TTQAPTTALQAAPSSHD (SEQ ID NO: 7), APSSHDATLGPSGGTSLSKT (SEQ ID NO: 8), SLSK-TGALTLANSVVSTP (SEQ ID NO: 9), NSVVSTPGG-PEGQWTSASAS (SEQ ID NO: 10), TSASAST-SPRTAAAMTHT (SEQ ID NO: 11), AAAMTHTHQAESTEASGQT (SEQ ID NO: 12), EAS-GQTQTSEPASSGSRTT (SEQ ID NO: 13), PASSGSRTT-SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), PVTYASSASTGDTTPLPVTDTSSVSTGHAT (SEQ ID NO: 22), STGDTLPLPVTDTSSV (SEQ ID NO: 23), VTSAPDTRPAPGSTAPPAHG (SEQ ID NO: 24), and PTTTPITTTTTVTPTPTPTGTQTPTTTPISTTC (SEQ ID NO:25) or a fragment of said peptides, or variants of said peptides in which variants any amino acid has been changed to a different amino acid, provided that no more than 5 of the amino acid residues in the sequence are so changed, and (ii) removing unbound sample, and (iii) qualitatively and/or quantitatively characterise the bound material, wherein peptides bound to said antibodies indicate cancer in the sample host.

The present inventors have raised several antibodies specific for different glycosylated parts of the mucin proteins. Accordingly, in one aspect the present invention relates to a method for detecting cancer, said method comprising (i) contacting a sample with at least two different antibodies, wherein said antibodies are capable of recognising two different glycosylated mucin peptides, wherein said peptide comprises at least 5 consecutive amino acid residues of a mucin selected from the group consisting of MUC4 (SEQ ID NO:1), MUC1 (SEQ ID NO: 2), MUC2 (SEQ ID NO: 26), MUC5AC (SEQ ID NO: 27), MUC6 (SEQ ID NO: 28), and MUC7 (SEQ ID NO: 29) or a naturally occurring fragment or variant of said mucin, wherein said variant is at least 70% identical to said at least 5 consecutive amino acid residues of said mucin, and (ii) removing unbound sample and/or unbound antibody, and (iii) qualitatively and/or quantitatively characterise the bound material, wherein peptides bound to said antibodies indicate cancer in the sample host.

In another aspect, the present invention relates to a method for detecting colorectal cancer, said method comprising (i) contacting a sample with a polyclonal antibody serum wherein said polyclonal antibody is capable of recognising at least two different O-glycosylated mucin peptides, wherein said peptides comprises at least 5 consecutive amino acid residues selected from the group consisting of MUC1 Variant CT58, MUC1 Variant CT80, MUC1 Variant SEC, MUC1 Variant X, MUC1 Variant Y, MUC1 Variant ZD, MUC2, MUC3A, MUC3B, MUC4, MUC5AC, MUC5B, MUC6, MUC7, MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin, and (ii) removing unbound sample and/or unbound antibody), and (iii) qualitatively and/or quantitatively characterise the bound material, wherein peptides bound to said antibodies indicate cancer in the sample host.

The antibodies of the present invention have been raised against different parts of glycosylated mucin polypeptides, Thus in one aspect, the present invention relates to a monoclonal antibody or an antigen binding fragment of said antibody, wherein said antibody or the antigen binding fragment of said antibody is capable of specifically recognising a mucin glycopeptide as defined herein above.

In one aspect the invention relates to a method for detecting cancer, said method comprising (i) contacting a sample with at least one first and at least one second antibody, wherein said first antibody is capable of recognising a first mucin peptide selected from the group consisting of the O-glycosylated MUC1 peptides VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3)RPAPGS(Core3)T(Core3)APPAHG (MUC1-15Core3), VT(STn)S(STn)APDT(STn)RPAPGS(STn)T(STn)APPAHG (MUC 1 (15STn), VT(STn)SAPDTRPAPGS(STn)T(STn)APPAHG (MUC1 9STn), VT(Tn)S(Tn)APDT(Tn)RPAPGS(Tn)T(Tn)APPAHG (MUC1 15Tn), VT(Tn)SAPDTRPAPGS(Tn)T(Tn)APPAHG (MUC1 9Tn), VT(Tn)SAPDTRPAPGST(Tn)APPAHG (MUC1 6Tn), and wherein said second antibody is capable of recognising another mucin peptide selected from the group consisting of:
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) PMT*DT*KTV*T*T*PGS*S*FT*AS*GHS*PS*EIVPQ DAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and
(ii) removing unbound sample, and
(iii) qualitatively and/or quantitatively characterise the bound material, wherein peptides bound to said antibodies indicate cancer in the sample host.

In one aspect the invention relates to a method for detecting cancer, said method comprising (i) contacting a sample with at least one antibody, wherein said antibody is capable of recognising a glycosylated mucin peptide, wherein said peptide comprises at least 5 consecutive amino acid residues of a mucin selected from the group consisting of MUC4 (SEQ ID NO: 1) and/or MUC1 (SEQ ID NO: 2), or a fragment or variant thereof, wherein said variant is at least 70% identical to said at least 5 consecutive amino acid residues of said mucin selected from the group consisting of MUC4 (SEQ ID NO: 1) and/or MUC1 (SEQ ID NO: 2), and
(ii) removing unbound sample and/or unbound antibody, and
(iii) qualitatively and/or quantitatively characterise the bound material, wherein peptides bound to said antibodies indicate cancer in the sample host.

In one aspect the present invention relates to a method for detecting colorectal cancer, said method comprising
(i) contacting a sample with at least one antibody, wherein said antibody is capable of recognising a glycosylated mucin peptide selected from the group consisting of PMTDTKTVTTPGSSFTA (SEQ ID NO: 3), PGSSFTASGHSPSEIVPQD (SEQ ID NO: 4), SEIVPQDAPTISAATTFAPA (SEQ ID NO: 5), TTFAPAPTGNGHTTQAPTTA (SEQ ID NO: 6), TTQAPTTALQAAPSSHD (SEQ ID NO: 7), APSSHDATLGPSGGTSLSKT (SEQ ID NO: 8), SLSKTGALTLANSVVSTP (SEQ ID NO: 9), NSVVSTPGGPEGQWTSASAS (SEQ ID NO: 10), TSASASTSPRTAAAMTHT (SEQ ID NO: 11), AAAMTHTHQAESTEASGQT (SEQ ID NO: 12), EASGQTQTSEPASSGSRTT (SEQ ID NO: 13), PASSGSRTTSAGTATPSSS (SEQ ID NO: 14), TATPSSSGASGTTPSGSEGI (SEQ ID NO: 15), SGSEGISTSGETTRFSSN (SEQ ID NO: 16), GETTRFSSNPSRDSHTT (SEQ ID NO: 17), PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), PVTYASSASTGDTTPLPVTDTSSVSTGHAT (SEQ ID NO: 22), STGDTLPLPVTDTSSV (SEQ ID NO: 23), VTSAPDTRPAPGSTAPPAHG (SEQ ID NO: 24), and PTTTPITTTTTVTPTPTPTGTQTPTTTPISTTC (SEQ ID NO:25) or a fragment of said peptides, or variants of said peptides in which variants any amino acid has been changed to a different amino acid, provided that no more than 5 of the amino acid residues in the sequence are so changed, and
(ii) removing unbound sample and/or unbound antibody
(iii) qualitatively and/or quantitatively characterise the bound material, wherein peptides bound to said antibodies indicate cancer in the sample host.

In one aspect the present invention relates to a monoclonal antibody or an antigen binding fragment of said antibody, wherein said antibody or the antigen binding fragment of said antibody is capable of specifically recognising a mucin glycopeptide as defined herein above. The recognition may be tested in a binding assay such as a Biacore assay (GE Healthcare, General Electric Company). These methods are well known to those skilled in the art.

The method used by the present inventors for raising antibodies is also part of the invention. Thus, in one aspect, the present invention relates to a method for producing the antibody defined herein above, said method comprising the steps of:
i) providing a host organism,
ii) immunizing the host organism with an O-glycosylated mucin as defined herein above, and
iii) obtaining said antibody.

The present invention is applicable to a subject undergoing therapy, such as surgery. In surgery the glycopeptide epitopes identified by the present inventors can be targeted with antibodies of the invention wherein the antibodies are conjugated to a visualization label, such as a fluorescent label. A variety of visualisation labels may be conjugated to the antibodies by methods well known to those skilled in the art, for example labels that are suitable for visualisation by X-ray fluoroscopes, Computer Assisted X-ray Tomography (CAT), Positron Emission Tomography (PET) and Nuclear Magnetic Resonance Imaging devices (NMRI). The epitopes can thus be visualised prior to or during surgery with the effect of more efficiently removing e.g. cancer tumours. Accordingly, in one aspect, the present invention relates to a method for detecting a cancer tumour in a patient undergoing therapy and/or examination, said method comprising the steps of:
(i) administering to an area of the patient, the antibody as defined herein above, or an antigen binding fragment of said antibody optionally labelled with a visualisation probe (i.e. a visualisation probe conjugated to the antibody of the invention) so that the antibody-visualisation probe complex acts as an imaging agent
(ii) removing unbound antibodies, and
(iii) detecting antibodies bound to glycopeptide epitopes as defined herein above, wherein labelling indicates presence of a tumour.

The glycopeptides of the invention have been used to construct a device for detecting disease, in particular cancer and especially colorectal cancer. Thus, in one aspect, the present invention relates to a device comprising a plurality of glycosylated peptides attached to a surface, wherein at least a part of the peptides are selected from the peptides defined herein above.

As discussed above, the glycopeptides and the antibodies of the invention act in a lock-and-key manner. Thus, in one aspect, the present invention relates to a device comprising a plurality of antibodies covalently attached to a surface, wherein at least a part of the antibodies are selected from the antibodies as defined herein, i.e. including but not limited to the antibodies selected from the group consisting of MAb 5C10, MAb 3C9, MAb 4D9, MAb 6C11 and MAb 6E3.

In one aspect the invention relates to a device comprising at least two different O-glycosylated peptides conjugated to a surface, wherein the at least two different peptides are selected from the peptides defined herein above.

In an analogous aspect, the invention relates to a device comprising a plurality of different antibodies conjugated to a surface, wherein one or more of the antibodies is/are selected from the antibodies defined herein.

In one aspect the device is used in a method of identifying glycopeptides such as glycopeptides associated with disease, said method comprising contacting the device defined herein above with a sample from a host organism. In a further aspect, when a plurality of antibodies have been conjugated to the surface of the device in place of glycopeptide constructs, said device can be used in a method to identify the corresponding O-glycosylated peptides associated with disease, said method comprising contacting said device with a sample from a host organism.

In another aspect, the device is used in a method of identifying glycopeptides associated with disease, said method comprising contacting said device with a sample from a host organism. When glycopeptides have been conjugated to the device, said device can be used in a method of identifying antibodies associated with disease, said method comprising contacting said device with a sample from a host organism.

In one aspect, the present invention relates to a mucin peptide as defined herein above for use as a medicament, in particular for use in a method of treatment of cancer. Said mucin peptide used in said method of treatment of cancer can e.g. include immunisation of an individual by administering to said individual the glycosylated mucin peptide. The medical use also applies to the other part of the lock-and-key invention. Thus, in this aspect the present invention relates to a method of immunising an individual, by administering to said individual an antibody of the invention.

The antibodies of the present invention can be used for detecting O-glycosylated peptides associated with disease. The O-glycosylated peptides in turn may be used to detect the autoantibodies also associated with disease. Thus in one aspect the present invention thus relates to a method of detecting an O-glycosylated peptide or the antibody as defined herein above, said method comprising conjugating an imaging agent to said peptide or antibody and detecting said imaging agent with any technique suitable thereto.

The peptides of the invention can be used individually or conjugated to a suitable object which may simplify the detection process. In one aspect the invention thus relates to a device comprising a plurality of glycosylated peptides conjugated to a surface, wherein at least a part of the peptides are selected from the peptides defined herein above. In another aspect the invention relates to a device comprising a plurality of antibodies conjugated to a surface, wherein at least a part of the antibodies are selected from the antibodies defined herein above.

The antibodies and the corresponding peptide epitopes of the present invention are not limited to methods for detecting disease, but can also be used in methods for treating disease. In one aspect the invention relates to a mucin peptide as defined herein above for use as a medicament. In one aspect the invention also relates to a mucin peptide as defined in herein for use in a method of treatment of cancer. In one aspect the invention relates to use of one or more antibodies as defined herein above for the manufacture of a medicament for the treatment of cancer. For example the antibodies of the invention can be used as passive immunization agents, singly or in combination to target cells of particular cancers. The antibodies can optionally be conjugated with one or more toxins that, alone or in combination, can kill cells targeted by the antibodies. Passive immunotherapy where antibodies binds to tumour cell surfaces and thereby facilitates tumour-killing by effector cells are also part of the invention. In one embodiment the antibodies of the invention are conjugated with a radioactive molecule capable of killing a tumour cell after binding of the antibody: radioactive molecule complex to the tumour cell surface.

In one aspect, the present invention relates to a method for identifying a disease (e.g. cancer such as colorectal cancer) associated with shedding of O-glycosylated peptides or peptide fragments, said method comprising the steps of:
(i) selecting potential target polypeptides containing potential O-glycosylation sites, and
(ii) producing recombinant fragments covering specific areas of interest from each potential target, and/or
(iii) producing synthetic peptides covering specific areas of interest from each potential target, and
(iv) in vitro glycosylate the fragments of (ii) and/or (iii) using recombinant glycosyltransferases
(v) purifying the fragments of (iv), and
(vi) characterizing the purified products of (v), and
(vii) printing of non-glycosylated and glycosylated targets,
(viii) screening the printed targets of (vii) with sera from a potentially diseased sample host and
(ix) screening the printed targets of (vii) with sera from a healthy sample host as control,
wherein the presence of auto-antibodies bound to the printed targets of (viii) indicates disease in the potentially diseased sample host.

While the present invention mainly is directed to a method of detecting cancer, it can also be applied for monitoring the efficacy or effect of radiotherapy and/or chemotherapy. Thus in one aspect the present invention relates to method for monitoring the efficacy of a chemotherapy and/or radiotherapy treatment, said method comprising the steps of
(i) contacting a sample from a sample host with at least two different mucin peptides, wherein said at least two different mucin peptides individually consists of an amino acid sequence comprising at least 5 consecutive amino acid residues, and wherein at least one of said at least 5 amino acid residues are Serine or Threonine, and wherein at least one of said Serine or Threonine residues is O-glycosylated by a glycan independently selected from the group consisting of:
Core-3 (GlcNAcβ1-3GalNAc-α-Ser/Thr),
Tn (GalNAc-α-Ser/Thr),
STn/sialyl-Tn (Neu5Acα2-6GalNAc-α-Ser/Thr),
Core-2 (Galβ1-3(GlcNAcβ1-6)GalNAc-α-Ser/Thr))
Core-4 (GlcNAcβ1-3(GlcNAcβ1-6)GalNAc-α-Ser/Thr), and
ST/sialyl-T (Neu5Acα2-3Galβ3GalNAc-Ser/Thr), and
(ii) removing unbound sample, and
(iii) qualitatively and/or quantitatively characterising the bound material, wherein antibodies or antigen binding fragments of antibodies, bound to said O-glycosylated peptides, is indicative of efficient/successful chemotherapy and/or radiotherapy treatment of the sample host.

(D) Analysis of O-glycopeptide specificity of detected auto-antibodies. Upper panel: Fluorescent images of the array showing the reactivity pattern of the same cancer patient serum, after pre-incubation with 40 μg/mL of unglycosylated MUC1 peptide, 15Core-3-MUC1, 15STn-MUC1, or Core-3-MUC5AC as control. Lower panel: Quantification of the STn-MUC1 and Core-3-MUC1 signal depicted in upper panel. The cancer specific serum reactivity to STn-MUC1 and Core-3-MUC1 was inhibited by 40 ug/mL of the respective MUC1 glycopeptides STn-MUC1 and Core-3-MUC1. No cross-reaction was observed.

Figure 4C:
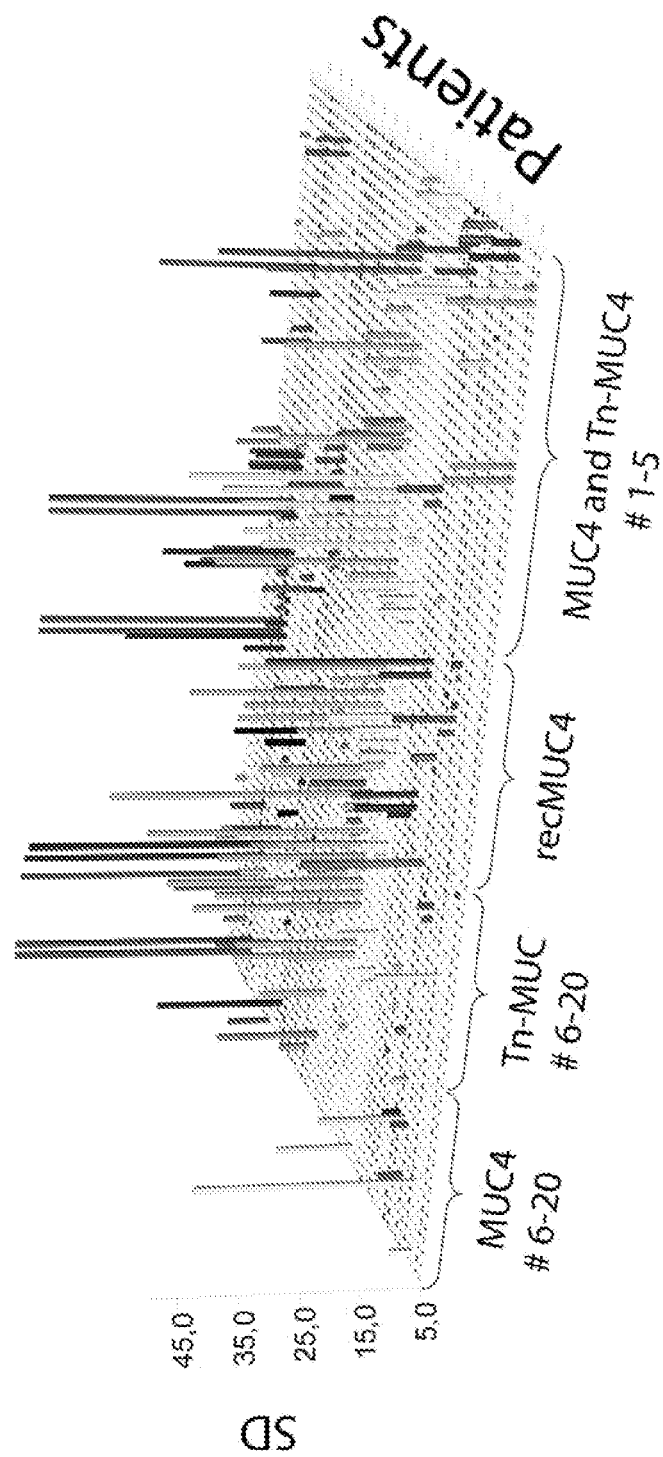

FIG. 4: Auto-antibodies of the IgA subclass targeting MUC4 preferentially identifies colorectal cancer patients. (A) Graphical overview of MUC4 and localization of recombinant MUC4 construct and short peptides covering the recombinant fragment and tandem repeat domain. (B) 3-dimensional bar graph illustrating IgA auto-antibodies against MUC4 non glycosylated and glycosylated peptides in healthy individuals, inflammatory bowel disease patients colorectal cancer patients, and a mixed population of breast, ovarian, and prostate cancer patients. (C) 3-dimensional bar graph Y-axis represents the number of standard deviations (SD) above the mean of the values obtained with sera from healthy individuals. The Y-axis cut-off level is 5 SD over the mean value of the controls.

FIG. 5: Monoclonal antibodies to Core3-MUC1 and Tn-MUC4. (A) MAb to Core3-MUC1 (5C10) characterized by ELISA. Antigen double dilution is presented on the x-axis. (B) Microarray characterization of mAb to Core3-MUC1 (5C10) on the mucin array. 2-Dimensional bar graph illustrating the relative fluorescent quantification of the array result. Specific reactivity was seen to Core3-MUC1 with Core3 structure in the PDTR sequence of MUC1 tandem repeat. (C) Monoclonal antibody to Tn-MUC4 (6E3) characterized by ELISA with different recombinant mucin glycoproteins. (D) Mucin micro-array characterisation of mAb 6E3. Strongest activity was seen to MUC4Tn. Less reactivity was seen toward MUC1Tn and MUC5ACTn. (E) Polyclonal response from a mouse immunized with Tn-MUC4TR5 analyzed by ELISA. Dilution of serum from eyebleed is presented on the X-axis. Glyco-peptide specific reactivity to Tn-MUC4TR5 was seen with no reaction to hapten Tn (on MUC2) or unglycosylated MUC4 peptide. (F) Serum from mouse immunized with Tn-MUC4TR5 on a focused MUC4 microarray. Reactivity was only seen to Tn-MUC4TR5 with no reactivity to non-glycosylated or other MUC4 Tn-glycopeptides.

Figure 6:
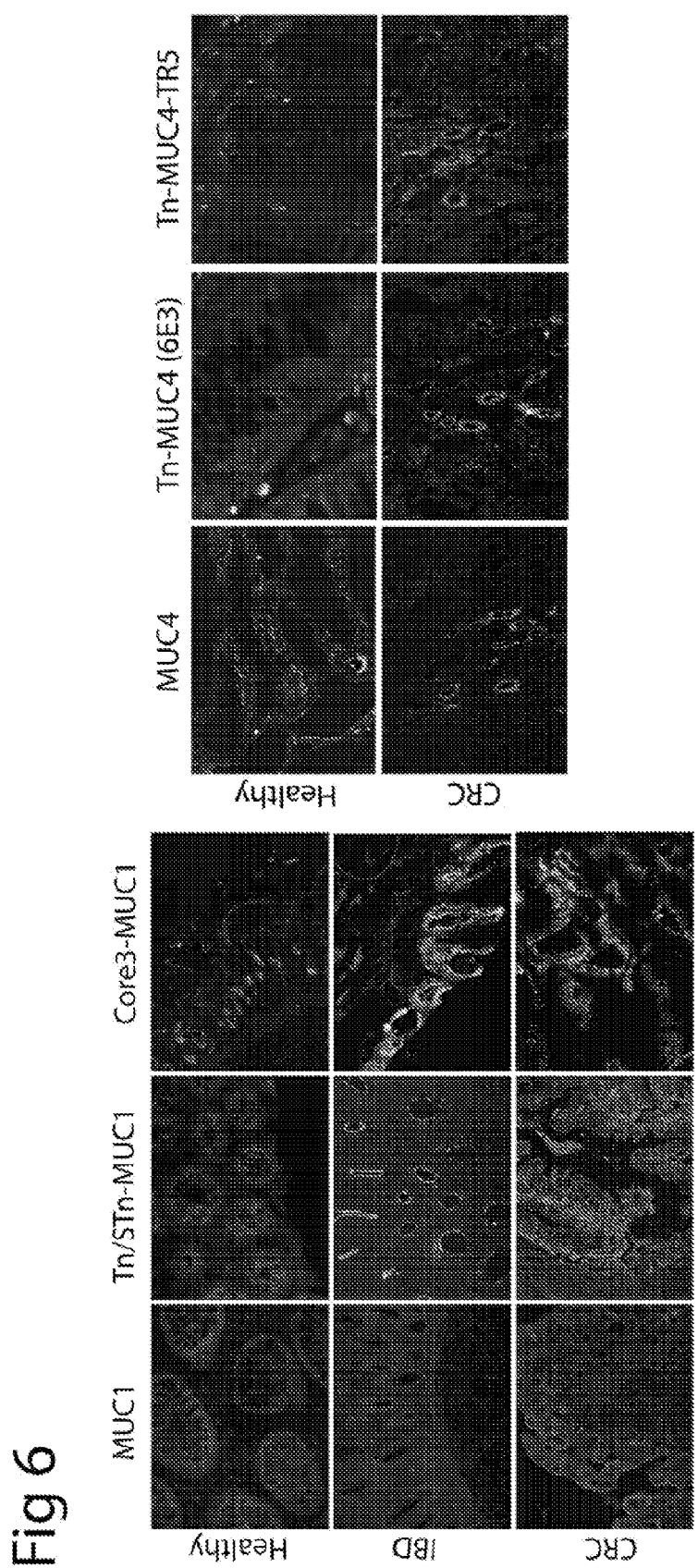

FIG. 6: FITC staining of tissue from colon. Sections of healthy colon, colon affected with inflammatory bowel disease, and colorectal cancer were stained with a panel of monoclonal antibodies for MUC1 (mAb HMHG2), Tn/STn-MUC1 (mAb 5E5), Core3-MUC1 (mAb 5C10), MUC4, Tn-MUC4 (6E3 and 4D9). Increased staining for Core3-MUC1 is seen with 5C10 in colorectal cancer and IBD compared with healthy colon. Albeit MUC4 is present in small quantities in healthy colon, an increase in staining intensity and surface expression is seen with a commercial MUC4 mAb, and the two Tn-MUC4 antibodies (6E3 and 4D9) in colorectal cancer.

Figure 7:
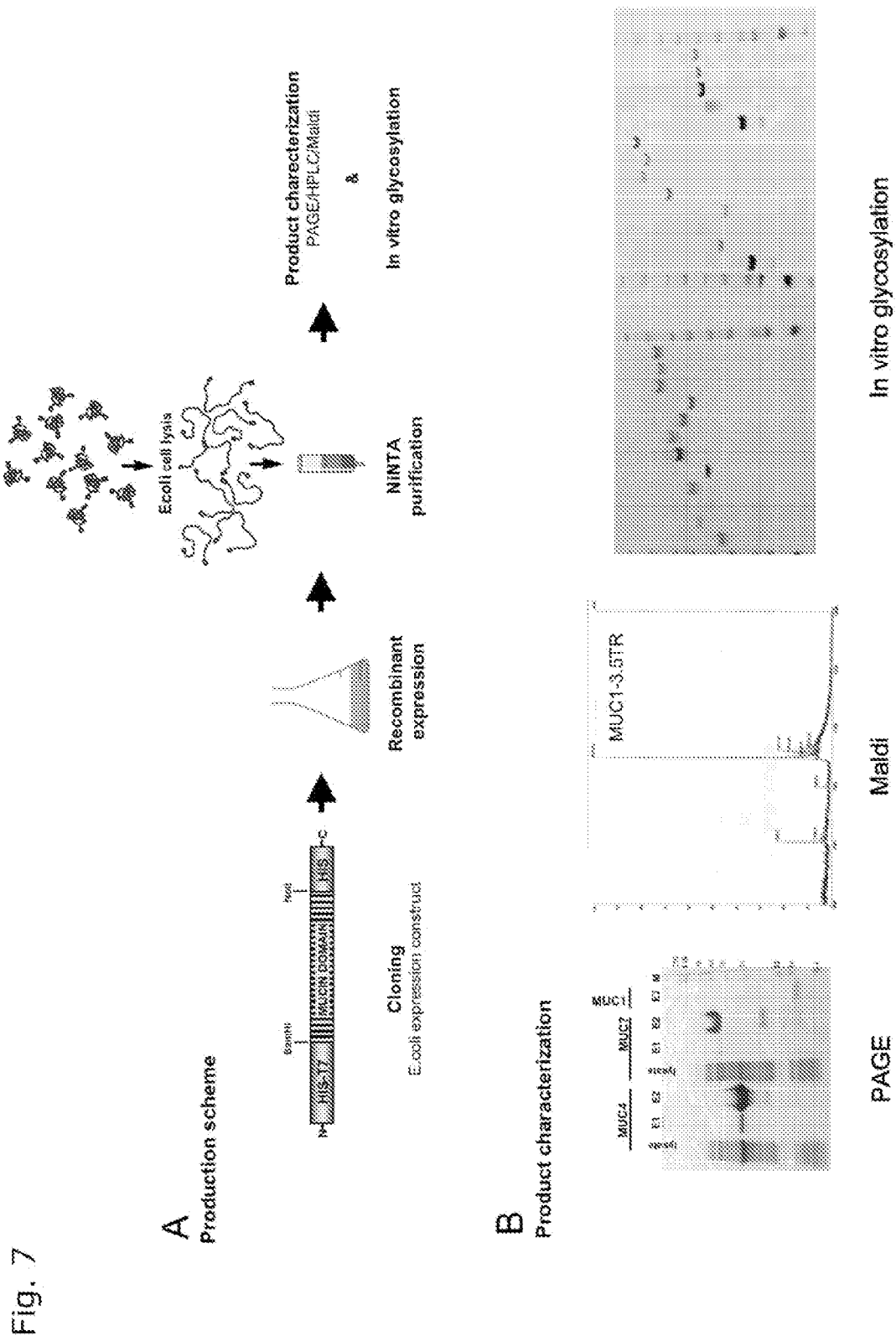

FIG. 7: Production of cancer-associated glycopeptides and glycoproteins. (C) Workflow from DNA construct to glycoprotein. Various construct designs were tested for optimal expression efficacy. Expression cultures were NiNTA and HPLC purified, analysed by Coomassie PAGE analysis and MALDI-TOF mass spectrometry analysis. Mucin constructs were expressed in pET28 with a N-terminal 6xHIS-T7 tag. Purified recombinant mucin fragments were in vitro glycosylated using purified human recombinant GalNAc-transferases. MALDI data for both naked purified recombinant protein and glycosylated recombinant protein (rMUC4+ T2 and rMUC7+ T2) is presented. The Tn glycoforms were further elongated to make cancer-associated glycoforms (Core-3, T and STn). Recombinant fragment of MUC2 (rMUC4) and MUC7 (rMUC7) are shown as examples. Similar results were obtained with the remaining mucin fragments.

Figure 8:
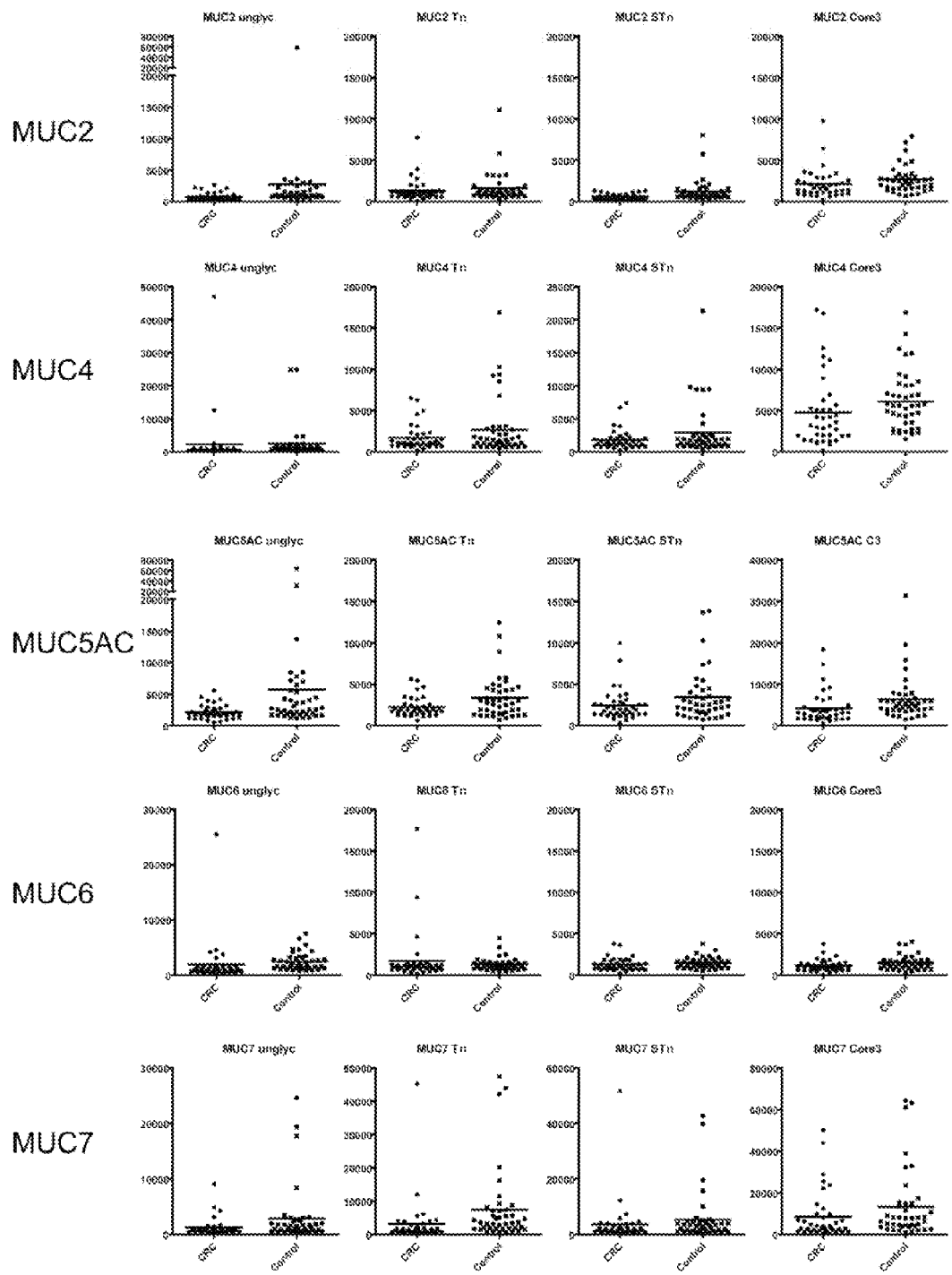

FIG. 8: Quantification of IgG auto-antibodies against recombinant protein MUC2, MUC4, MUC5AC, MUC6 and MUC7. Differential auto-antibody responses to recombinant protein MUC2, MUC4, MUC5AC, MUC6 and MUC7 between colorectal cancer patients compared with healthy controls were not identified.

Figure 9:
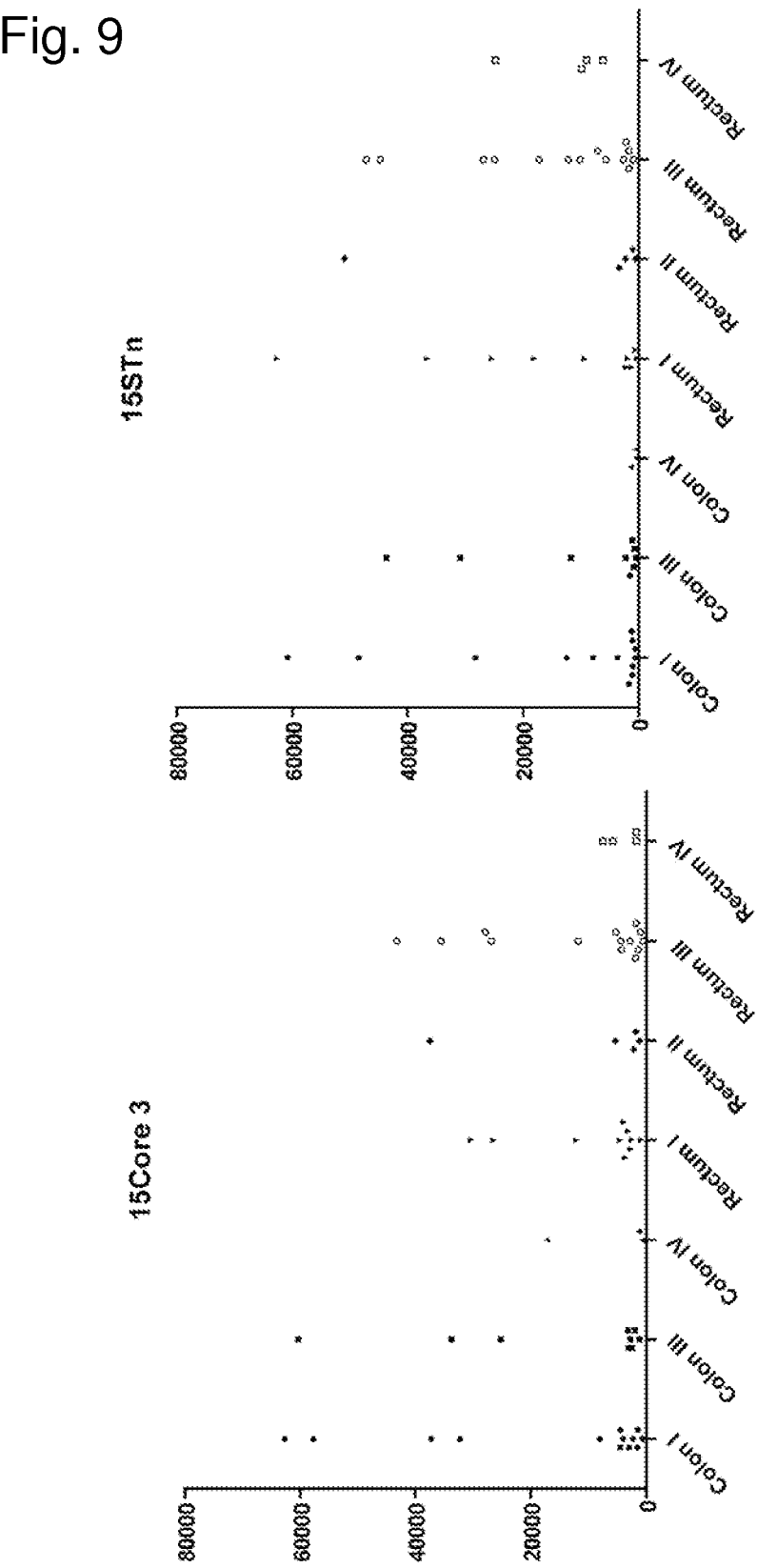
Figure 10A:
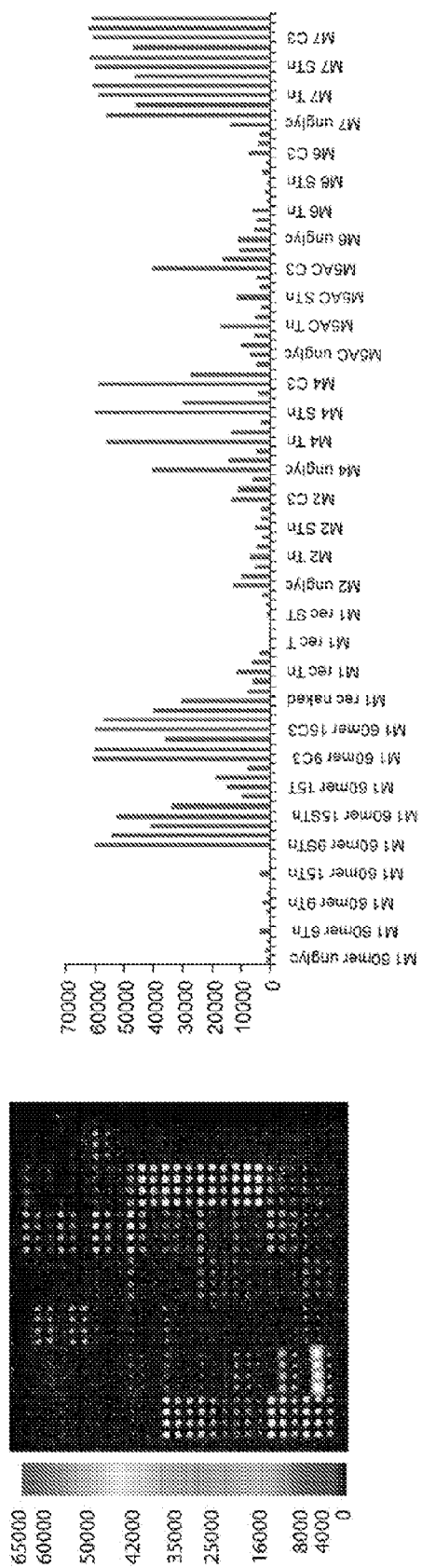
Figure 10C:
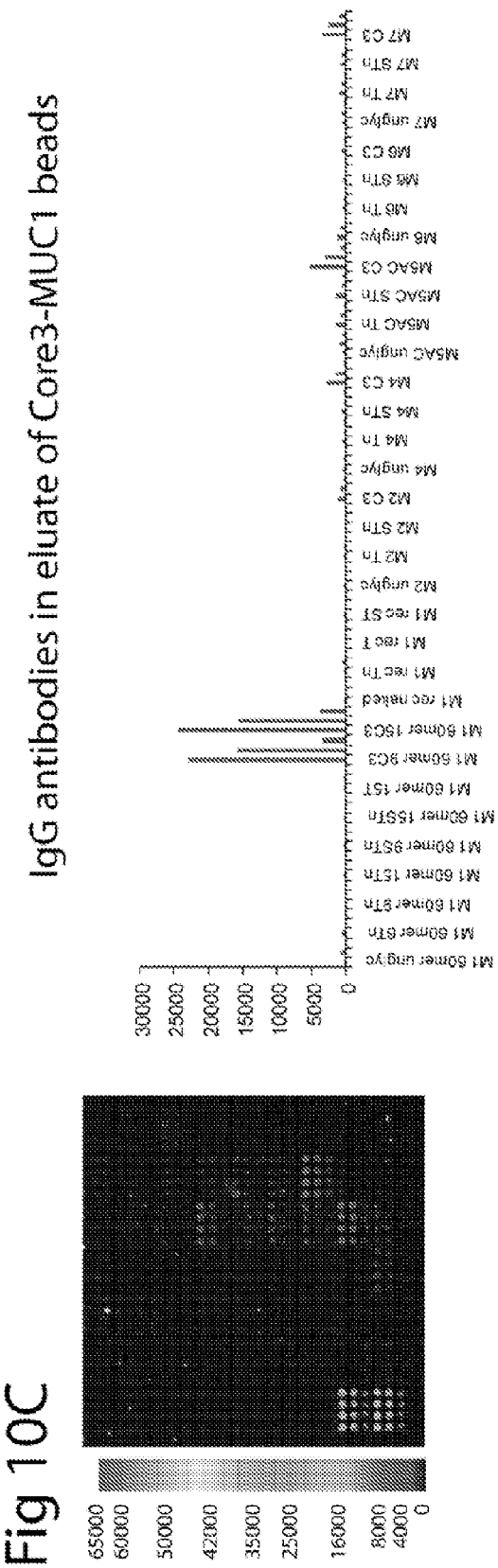
Figure 10D:
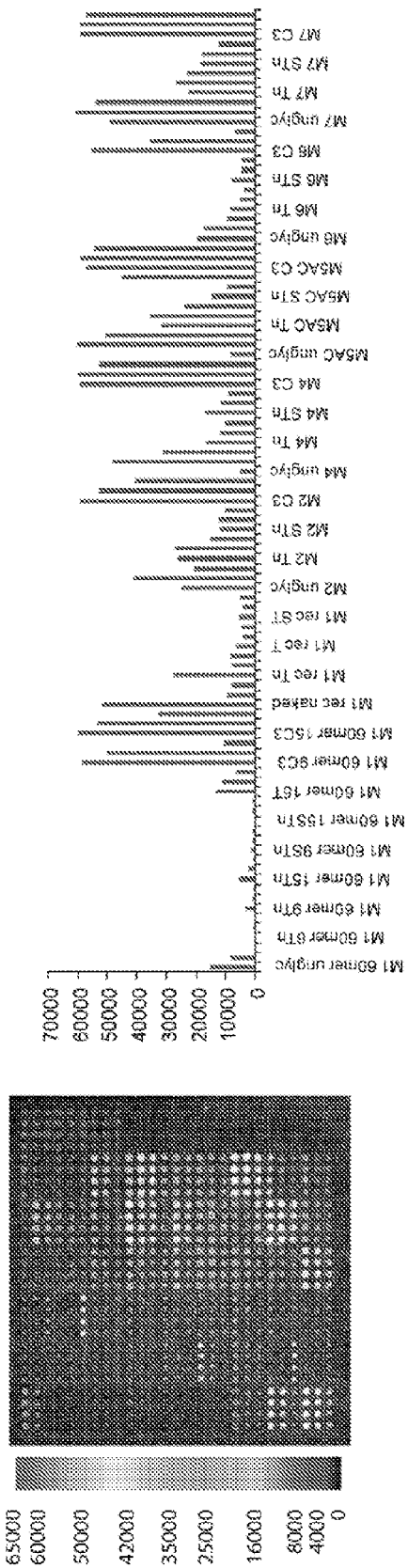
Figure 10D:
Figure 10E:
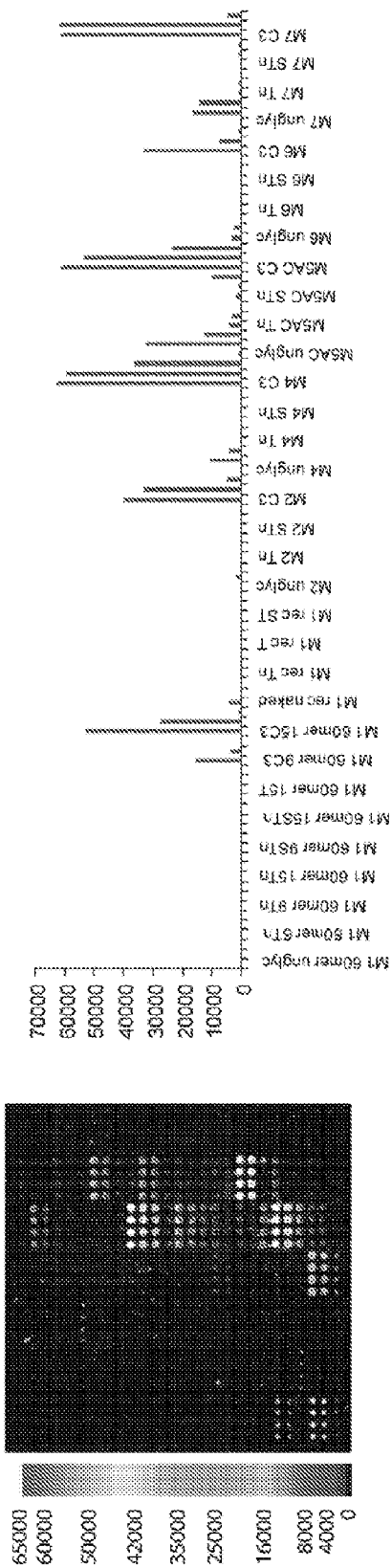

FIG. 9: DOT-PLOT diagram presenting auto-antibodies to Core3-MUC1 and STn-MUC1 in the colorectal cancer patients. The patients are subdivided in accordance to the location and to the stage of the tumour.

FIG. 10: Purification and characterization of auto-antibodies from cancer serum (A) IgG auto-antibodies from a colorectal cancer patient evaluated on the mucin array. Auto-antibodies are seen to STn-MUC1, Core3-MUC1, and other recombinant mucins mainly with the Core-3 glycans. (B) Reactivity of IgG auto-antibodies after pre-absorption of Core-3-MUC1 auto-antibodies by incubation of the serum with recombinant Core3-MUC1 coupled to dynabeads via Histidine tag. The Core3-MUC1 signal is reduced over 90%, while STn-MUC1 and the other mucins carrying the Core3-glycans are unaffected. (C) Core-3-MUC1 specific IgG auto-antibodies eluted from the Core3-MUC1-dynabeads incubated with serum. Specific reactivity to Core3-MUC1 was recovered. (D) IgM antibodies in serum from the same cancer patient. Reactivity was seen towards different proteins especially carrying Core-3. (E) IgM auto-antibodies eluted from Core3-MUC1-dynabeads after incubation with the same cancer serum. Eluted IgM auto-antibodies reacted with all carriers of Core-3.

Figure 11A:
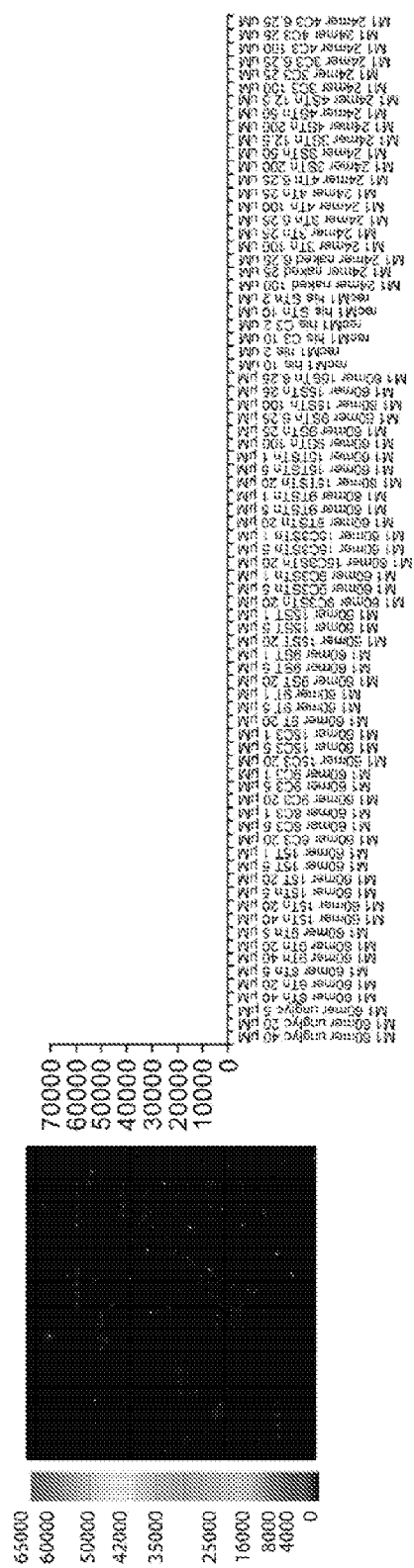
Figure 11B:
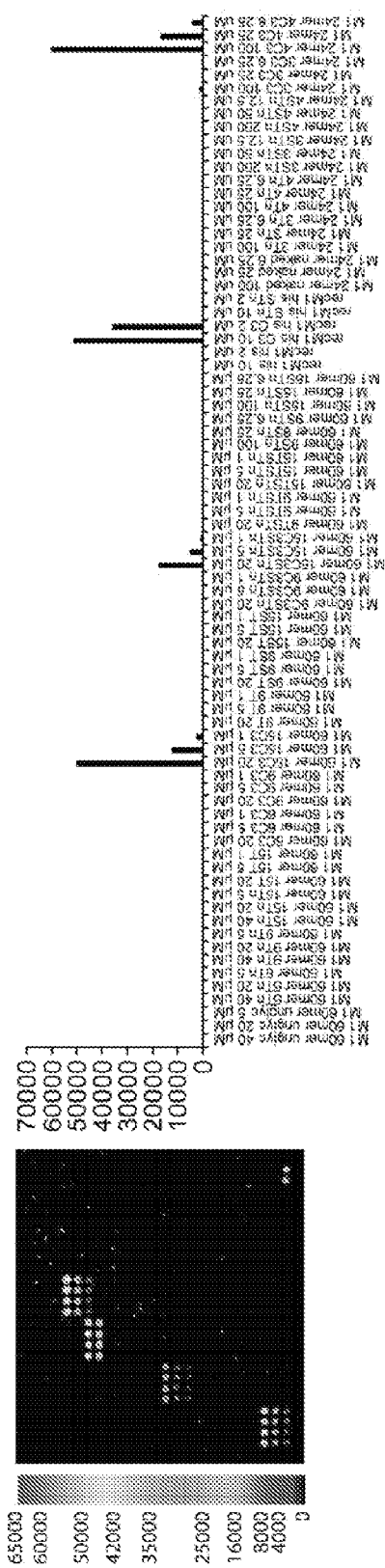

FIG. 11: Characterization of Mab 5C10 to Core-3-MUC1 (A) MAb 5C10 characterized by MUC1 microarray. Specific reactivity was seen to Core3-MUC1 with Core3 structure in the PDTR sequence of MUC1 tandem repeat. (B) MAb 5C10 characterized on the MUC1 microarray after elongation of Core-3-MUC1 with galactose (Galb3GlcNAcb3GalNAcα) by the glycosyl-transferases beta3Gal-T5. The reactivity to Core3-MUC1 where completely diminished after elongation.

Figure 12:
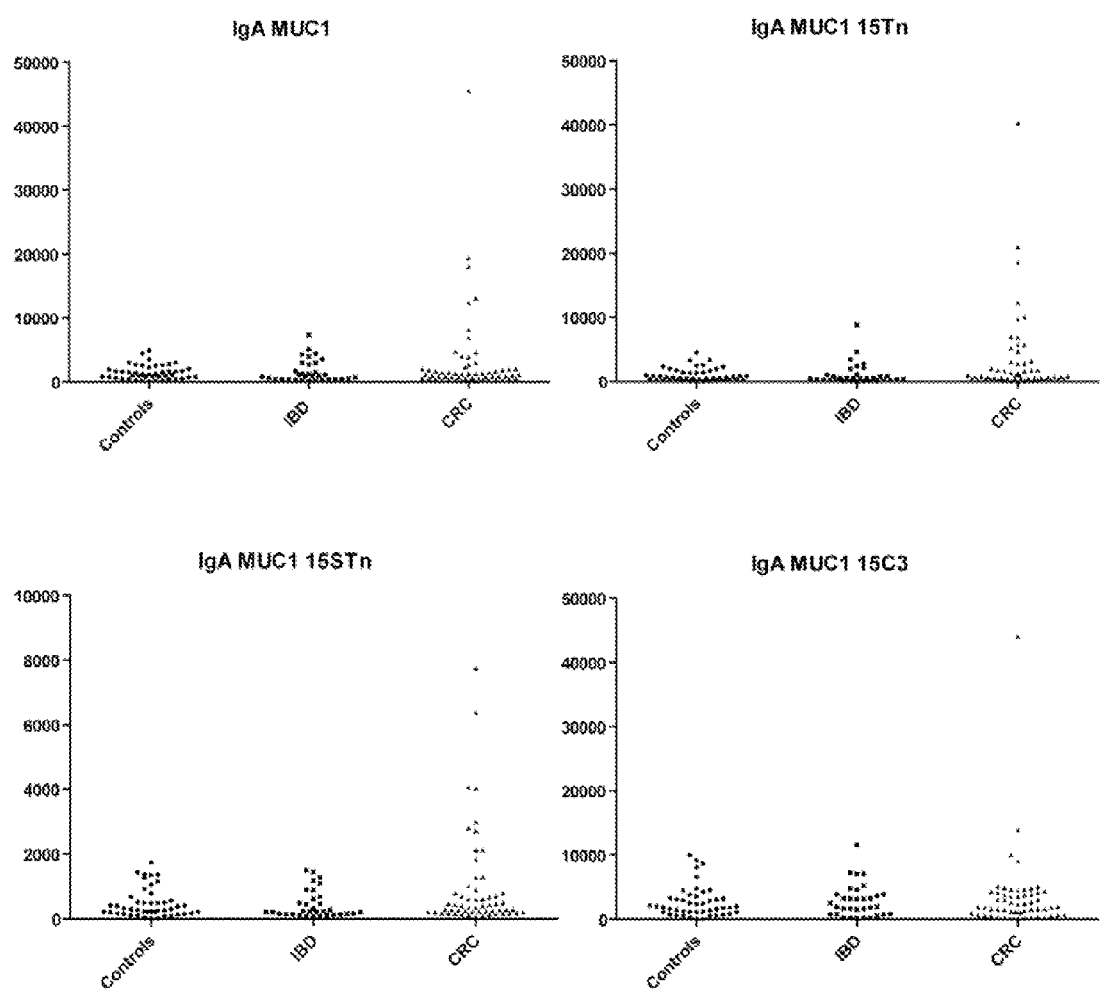

FIG. 12: IgA autoantibodies to MUC1 Glycopeptides. DOT-PLOT diagram presenting IgA auto-antibody reactivity against MUC1 (A), Tn-MUC1 (B), STn-MUC1 (C), and Core-3-MUC1 (D) in healthy individuals (blood donors), Colorectal cancer patients, Inflammatory bowel disease patients.

Figure 13:
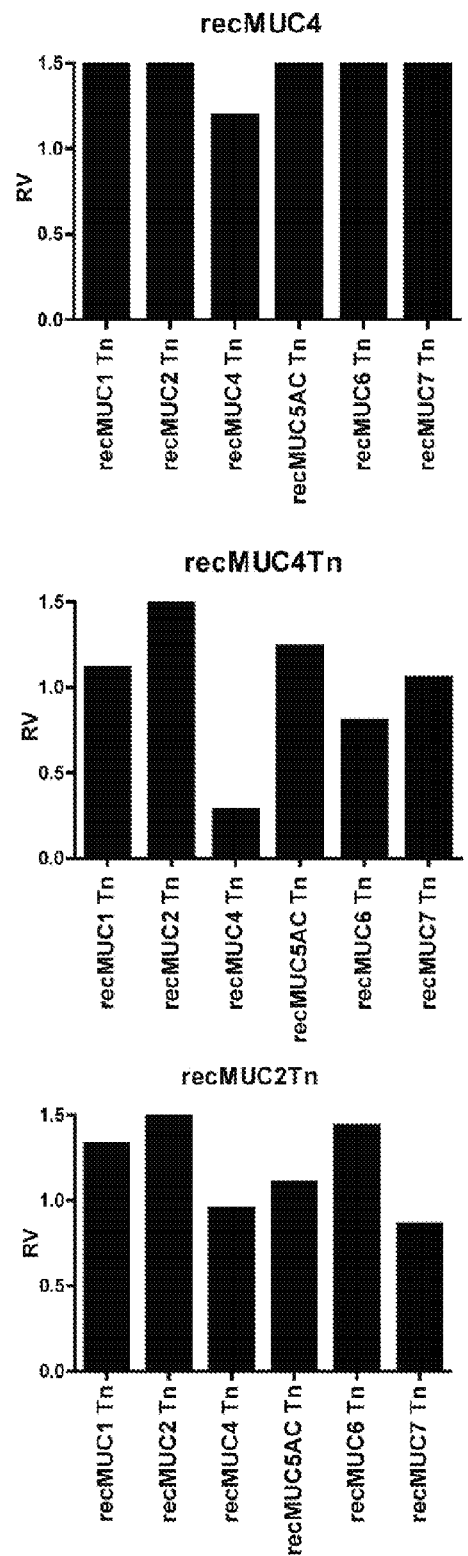

FIG. 13: Specificity of IgA autoantibodies to Tn-MUC4 Selective inhibition of autoantibodies to recombinant Tn-MUC4. Bar diagram with quantifications of the Tn-MUC1, Tn-MUC2, Tn-MUC4, Tn-MUC5AC, Tn-MUC6, and 7 reactivity inhibited with 40 μg/mL of unglycosylated MUC4, tn-MUC4 or Tn-MUC2. RV: relative value.

Figure 14:
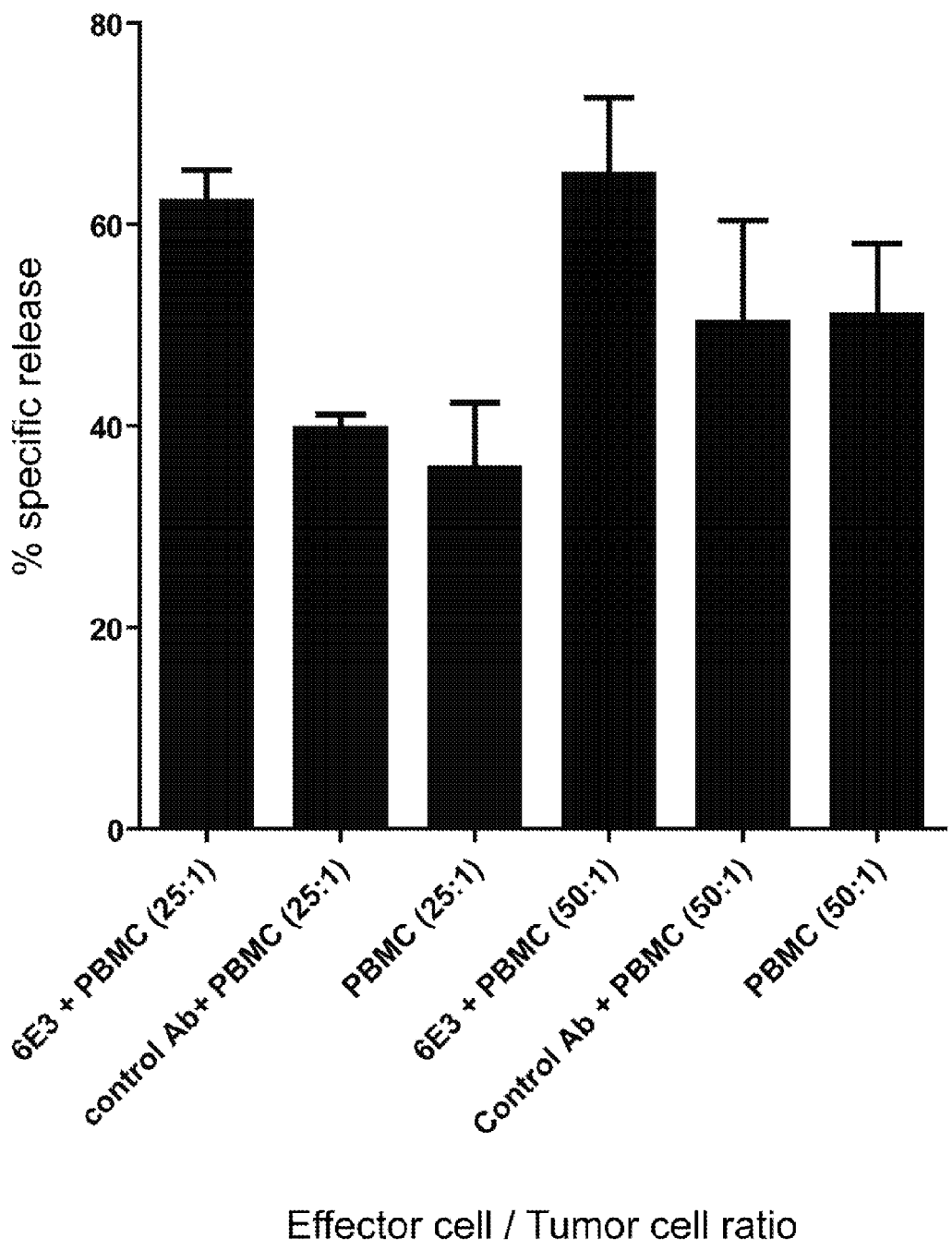

FIG. 14: Antibody-Dependent Cellular Cytotoxicity (ADCC) MCF7 The bar graph presenting the antibody-dependent cellular cytotoxocity of PBMC (Peripheral blood mononuclear cells) with 6E3, a negativ control antibody, and PBMC alone. Results from effector cell/tumor ratio of 25:1 and 50:1 are shown. On the y-axis is the percentage of the specific release of 51Cr. The error bars indicates standard deviation.

Figure 15:
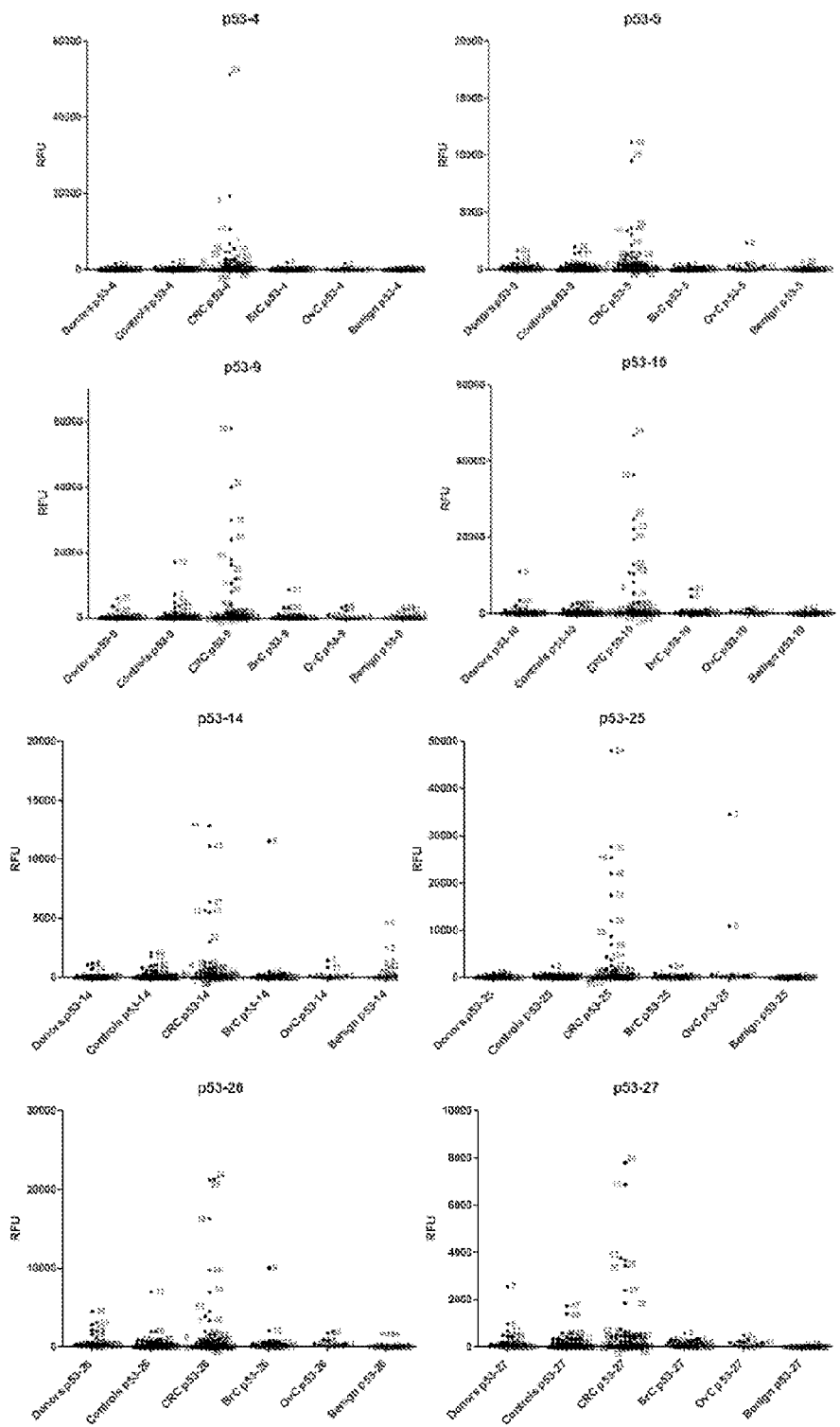

FIG. 15: DOT-PLOT diagram presenting autoantibody reactivity against p53 derived peptides. Each dot represents one individual in the groups blood donors (n=29), 53 healthy controls (n=53), colorectal cancer patients (n=58), breast cancer patients (n=26), ovarian cancer patients (n=12), and benign diseases (n=20, mixture of patients with benign breast tumors, benign ovarian tumors, and prostate hyperplasia). The relative fluorescence units (RFU) are presented on the y-axis.

DETAILED DESCRIPTION OF THE INVENTION

Definitions

Disorder: The term 'disorder' used herein refers to a disease or medical problem, and is an abnormal condition of an organism that impairs bodily functions, associated with specific symptoms and signs. It may be caused by external factors, such as invading organisms, or it may be caused by internal dysfunctions, such as impaired catecholamine production or transport. In particular, a disorder as used herein is cancer.

Glycan: The term glycan as used herein refers to a polysaccharide or oligosaccharide. Glycan may also be used to refer to the carbohydrate portion of a glycoconjugate, such as a glycoprotein, glycolipid, or a proteoglycan. Glycans usually consist solely of O-glycosidic linkages of monosaccharides. For example, cellulose is a glycan (or more specifically a glucan) composed of beta-1,4-linked D-glucose, and chitin is a glycan composed of beta-1,4-linked N-acetyl-D-glucosamine. Glycans can be homo or heteropolymers of monosaccharide residues, and can be linear or branched.

Glycans of the invention are listed below. N-Acetylgalactosamine (GalNAc), is an amino sugar derivative of galactose (2-Acetamido-2-deoxy-D-galactose) with the molecular formula $C_8H_{15}NO_6$. N-Acetylglucosamine (GlcNAc), is an amino sugar derivative of glucose (2-Acetamido-2-deoxy-D-glucose) with the molecular formula $C_8H_{15}NO_6$.

Galactosamine is a hexosamine derived from galactose with the molecular formula $C_6H_{13}NO_5$.

Sialic acid is a generic term for N-acetylneuraminic acid (Neu5Ac or NANA). The amino group can be varied with either an acetyl or glycolyl group but other modifications have been described. The hydroxyl substituents may vary considerably: acetyl, lactyl, methyl, sulfate, and phosphate groups have been found.

STn or sialyl-Tn antigen: (Neu5Acα2-6GalNAc-Ser/Thr)
Tn or Tn antigen: (GalNAc-Ser/Thr)
Core-2: Galβ3(GlcNAcβ6)GalNAc-Ser/Thr
Core-3: GlcNAcβ3GalNAc-Ser/Thr
Core-4: GlcNAcβ3(GlcNAcβ6)GalNAc-Ser/Thr
ST or sialyl-T (Neu5Acα2-3Galβ3GalNAc-Ser/Thr)

Pharmaceutical composition: or drug, medicament or agent refers to any chemical or biological material, compound, or composition capable of inducing a desired therapeutic effect when properly administered to a patient. Some drugs are sold in an inactive form that is converted in vivo into a metabolite with pharmaceutical activity. For purposes of the present invention, the terms "pharmaceutical composition" and "medicament" encompass both the inactive drug and the active metabolite.

Polypeptide: The term "polypeptide" as used herein refers to a molecule comprising at least two amino acids. The amino acids may be natural or synthetic. "Oligopeptides" are defined herein as being polypeptides of length not more than 100 amino acids. The term "polypeptide" is also intended to include proteins, i.e. functional biomolecules comprising at least one polypeptide; when comprising at least two polypeptides, these may form complexes, be covalently linked or may be non-covalently linked. The polypeptides in a protein can be glycosylated and/or lipidated and/or comprise prosthetic groups.

Protein: The term 'protein' used herein refers to an organic compound, also known as a polypeptide, which is a peptide having at least, and preferably more than two amino acids. The generic term amino acid comprises both natural and non-natural amino acids any of which may be in the 'D' or 'L' isomeric form.

Methods for Detecting Disease

The present inventors have developed a chemo-enzymatic approach to produce libraries of disease-associated O-glycopeptides such as cancer-associated O-glycopeptides printed on a microarray platform allowing high through-put detection of auto-antibodies to the O-glycopeptidome. Based on this the inventors have created an expanded mucin glycopeptide array to identify disease-associated glycopeptide targets. The inventors have for example created an expanded mucin glycopeptide array useful in identifying cancer associated glycopeptide targets being specific for detection of colon cancer specific autologous antibodies.

While the invention is useful in the detection of autoantibodies and corresponding glycopeptide epitopes recognised by said autoantibodies, the invention is also applicable to any glycopeptide associated with disease or disorder. The data provides clear support for the utility of this approach and provides guidance for the person skilled in the art to further improve specificity and sensitivity of the targets provided. As a solution to the need for biomarkers for the early detection of disease such as, but not limited to cancer the present inventors have found that specific changes in post-translational modifications, such as glycosylation pattern of the translated proteins are useful in detecting disease. In relation to cancer, these changes also provide recognizable patterns that may be used to discriminate between cancer such as colorectal cancer and inflammatory disease of the gastrointestinal tract.

In principle the present invention is applicable to any glycosylated peptide epitope and a corresponding antibody, acting in a lock and key-manner, for the detection of various disorders and diseases. The present inventors have found that the efficiency of detection is particularly good when two or more different glycosylated peptides are used for the detection of disease.

In one aspect the present invention concerns a method for detecting a disease in a host organism wherein said disease is characterised in that autoantibodies are produced by the individual suffering from the disease, said method comprising (i) contacting a sample from said host organism with at least two different O-glycosylated peptides, and
(ii) removing unbound sample, and
(iii) qualitatively and/or quantitatively characterise the bound material, wherein antibodies bound to the peptides of step (i) are indicative of disease or disorder in the host organism.

In one embodiment, the at least two different O-glycosylated peptides are mucin peptides.

In one embodiment of the above method, the disease is cancer.

In a further embodiment the cancer is selected from the group consisting of colorectal cancer, breast cancer, oral cancer, gastric cancer, esophageal cancer, pancreatic cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

The glycopeptide targets in MUC1 (Tn-MUC1, STn-MUC1, Core-3-MUC1) found by the inventors, are recognised by auto-antibodies in colorectal cancer patients. In addition the inventors have found epitopes in Tn-MUC4 (GalNAc-α1MUC4), which allowed the inventors to distinguish between colorectal cancer patients and healthy individuals and patients with inflammatory bowel disease, respectively.

Thus in one embodiment the cancer detected or treated by the present invention is colorectal cancer.

The novel concept for the simple and non-invasive identification of patients with e.g. colorectal cancer is a significant advantage over current screening techniques by its use of immunological amplified signals present at early stages of the disease. The strategy can be performed alone or in combination with current screening efforts such a colonoscopy. Conventional endoscopic screening is limited due to lack of molecular specificity and because only anatomical changes are revealed through a macroscopic view of the surface mucosa. Therefore, flat or depressed neoplasms are difficult to detect using endoscopic methods, and especially patients with chronic inflammatory bowel disease are at increased risk of developing malignancy due to undetected dysplastic lesions. There is thus a need for improved methods for detecting early changes in high-risk individuals. New approaches includes the use of novel imaging techniques as well as combining endoscopic efforts with fluorescent imaging with either non-specific or specific dyes (Hsiung, Hardy et al. 2008). Another perspective is to combine these approaches with serum markers, which could serve as indicators for the presence of disease and hence warrant further examination by existing techniques. In this way serum marker strategies could be complementary to anatomical data provided by imaging techniques.

In summary, the inventors have provided enabling support for a novel O-glycopeptide array for the sensitive detection of disease-associated auto-antibodies, such as cancer associated auto-antibodies. The data furthermore provides clear support for the utility of this approach and provides guidance for the person skilled in the art to further improve specificity and sensitivity of the targets provided. The invention thus provides a method for screening patients routinely for possible presence of a disease, imaging agents for in situ disclosure and definition of the volume of diseased tissue, and highly specific therapeutic agents to treat the disease.

In relation to colorectal cancer, the inventors have found that patients afflicted with colorectal cancer selectively generate antibodies recognizing Tn-MUC1, STn-MUC1 and Tn-MUC4, while auto-antibodies against Core-3-MUC1 were generated in both colorectal cancer and inflammatory bowel patients. Combining the cancer associated glycoforms of MUC1 and MUC4 as target antigens resulted in detection of 82% of the cancer patients with a specificity of 95% (See table II).

Figure 2B:
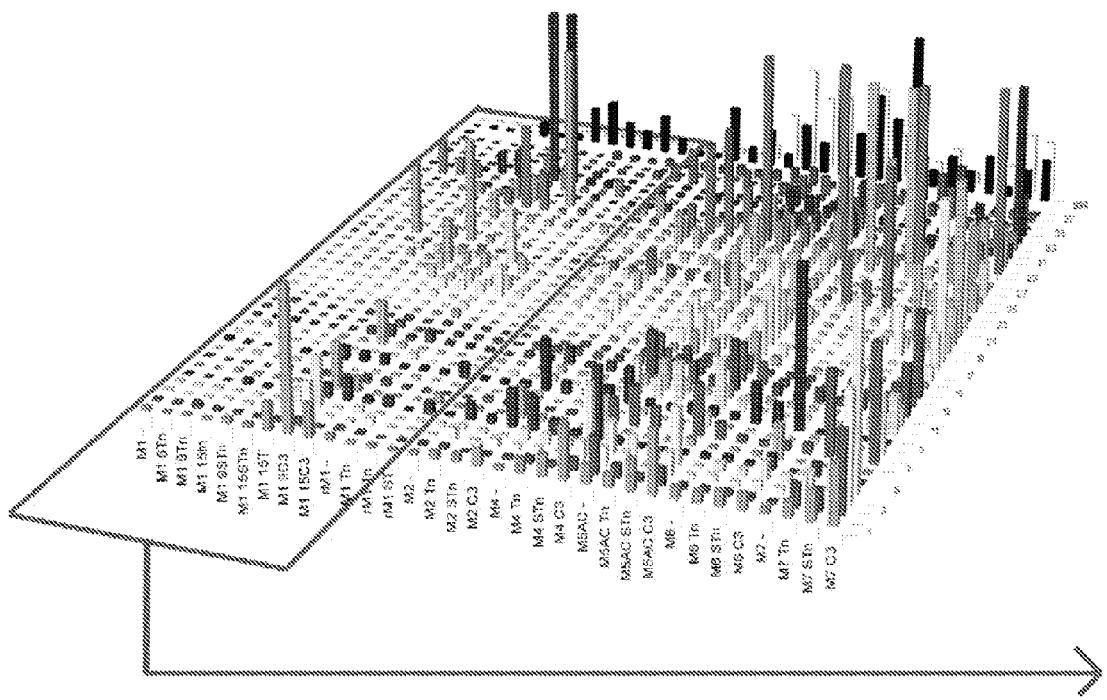
FIG. 2: IgG auto-antibodies to MUC1 glycopeptides Quantification of the antibody responses for glycopeptide targets in each individual shown in a 3-dimensional bar graph for healthy individuals (n=50) (A), inflammatory bowel disease patients (UC or CD in active or remission phase; n=39) (B), and colorectal cancer patients (Pre-treatment (n=58), Stage I-IV, (I n=23, II n=5, III n=23, IV n=7)) (C). Columns indicate the IgG reactivity in serum from one patient (y-axis) expressed as relative fluorescence units (z-axis) for each listed compound x-axis). MUC1 glycopeptide targets were predominantly recognised by colorectal cancer patients as demonstrated in DOT-PLOT diagram illustrating the level of IgG autoantibody reactivity of each individual towards glycoforms of MUC1 (DOT-PLOT only depict results from selected boxed target glyco-peptides from 3-dimensional bar graph). Dots in DOT-PLOT represent the relative fluorescent value for individual controls and patients. Healthy individuals demonstrated none or very low reactivity against Tn- and STn-MUC1 glycoforms (D). A significant number of patients with Inflammatory Bowel Disease (IBD) had auto-antibodies against Core-3-MUC1 compared with healthy individuals (E). In contrast only few IBD patients had auto-antibodies against Tn- and STn-MUC1. In colorectal cancer IgG auto-antibodies were detected against Tn-, STn, and Core-3-MUC1 in a large proportion of the patients (F), with 15STn-MUC1 being the best marker to distinguish the cancer group from the healthy group. For Tn- and STn MUC1 similar reactivity was seen between recombinant (rMUC1) and synthetic peptides (MUC1) covering the MUC1 tandem repeat. Statistical details are shown in FIG. 3.
Figure 2E:
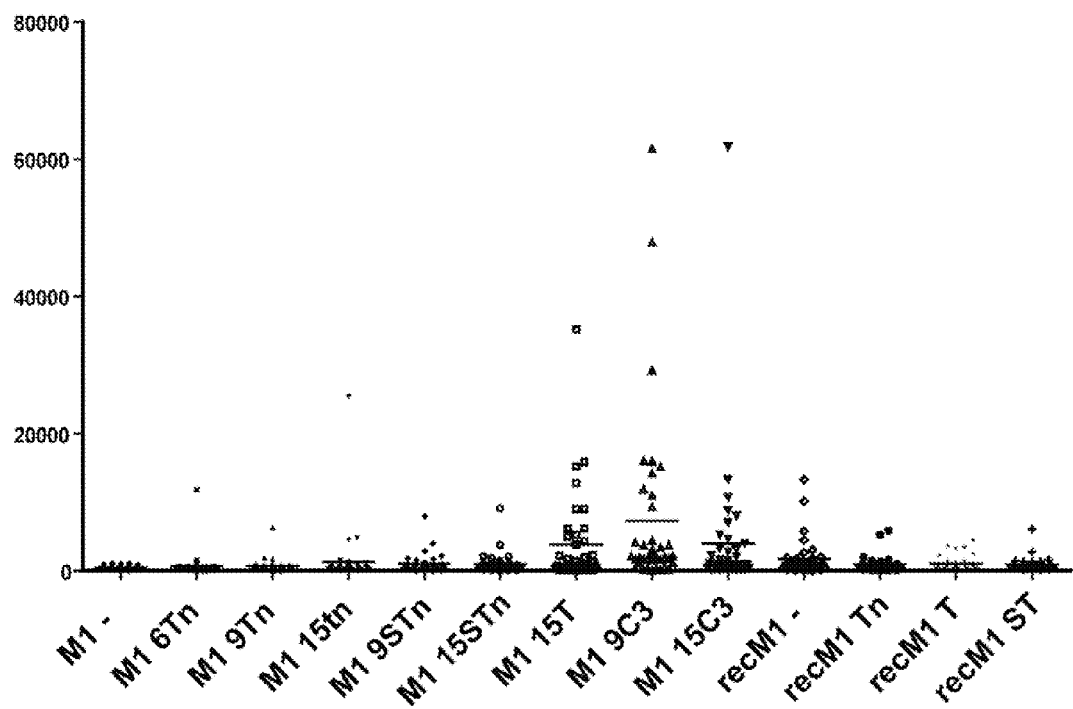

The inventors have found that the predominant epitope identified by auto-antibodies against STn and Core-3-MUC1 is located in the -GSTAP- motif of the MUC1 tandem repeat sequence carrying two glycans, while a few patients have additional immunoreactivity with glyco-peptides with one glycan in either T in -VTS- or T in -PDTR (See FIG. 2 and Table II).

Figure 3B:
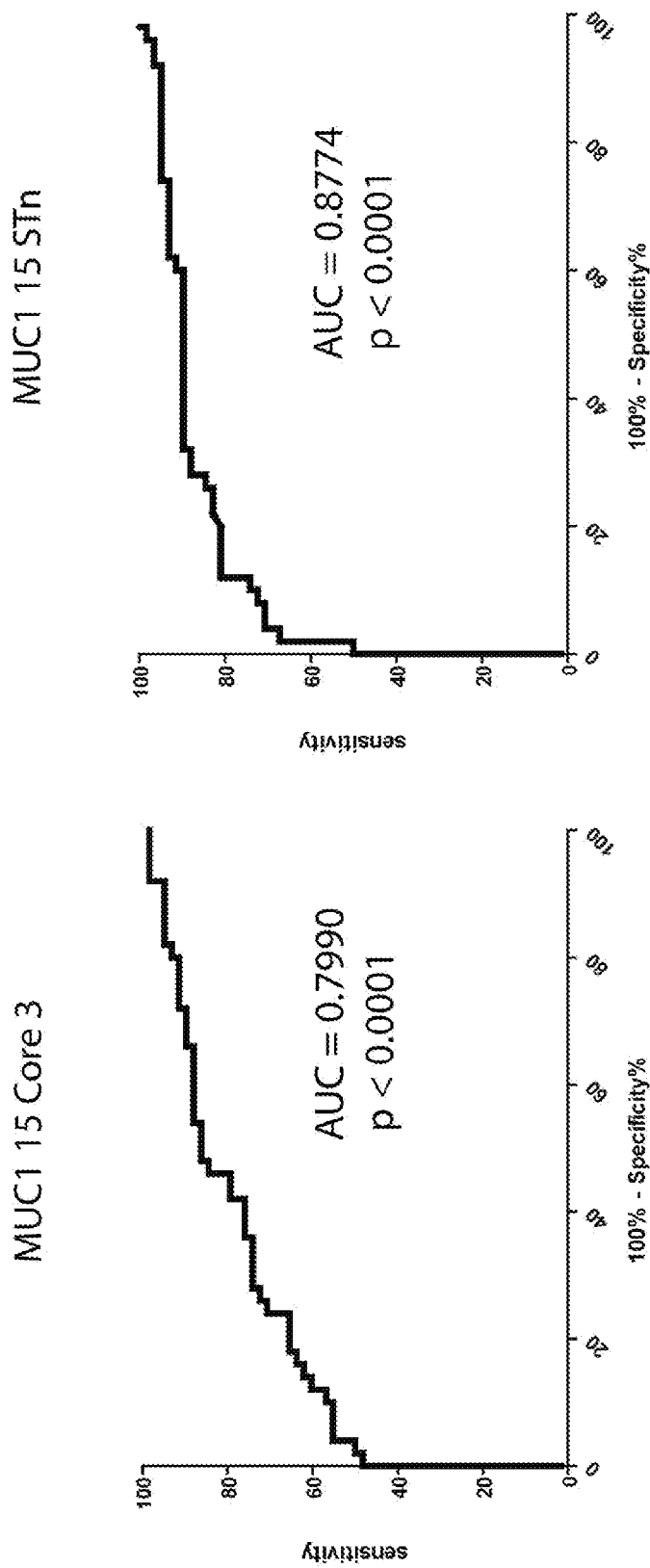
FIG. 3: Sialyl-Tn-MUC1 auto-antibodies predict the presence of colorectal cancer. (A) Focused DOT-PLOT diagram presenting auto-antibody reactivity against Core3-MUC1 and STn-MUC1. Each dot represents the relative fluorescent unit for each individual in the three groups of patients examined (i) Healthy individuals (blood donors), (ii) Colorectal cancer patients (Pre-treatment, Stage I-IV), (iii) Inflammatory bowel disease patients. 56.7% of patients with established colorectal cancer have significantly increased level of auto-antibodies to STn-MUC1 (above 3 standard deviation over the mean value of the healthy control group. (B) ROC curve for serum IgG antibodies to Core3-MUC1 and STn-MUC1. Area under the curve is 0.7944 and 0.8774 respectively. The value of specificity is plotted as 1-specificity on the x-axis. (C) DOT-PLOT diagram of auto-antibody reactivity in colorectal cancer patients without (stage I-III) or with metastasis (stage IV). Patients with metastasis have lower activity of auto-antibodies against Core3-MUC1 and STn-MUC1. See FIG. 8 for further characterization of the sub-groups.
Figure 3C:
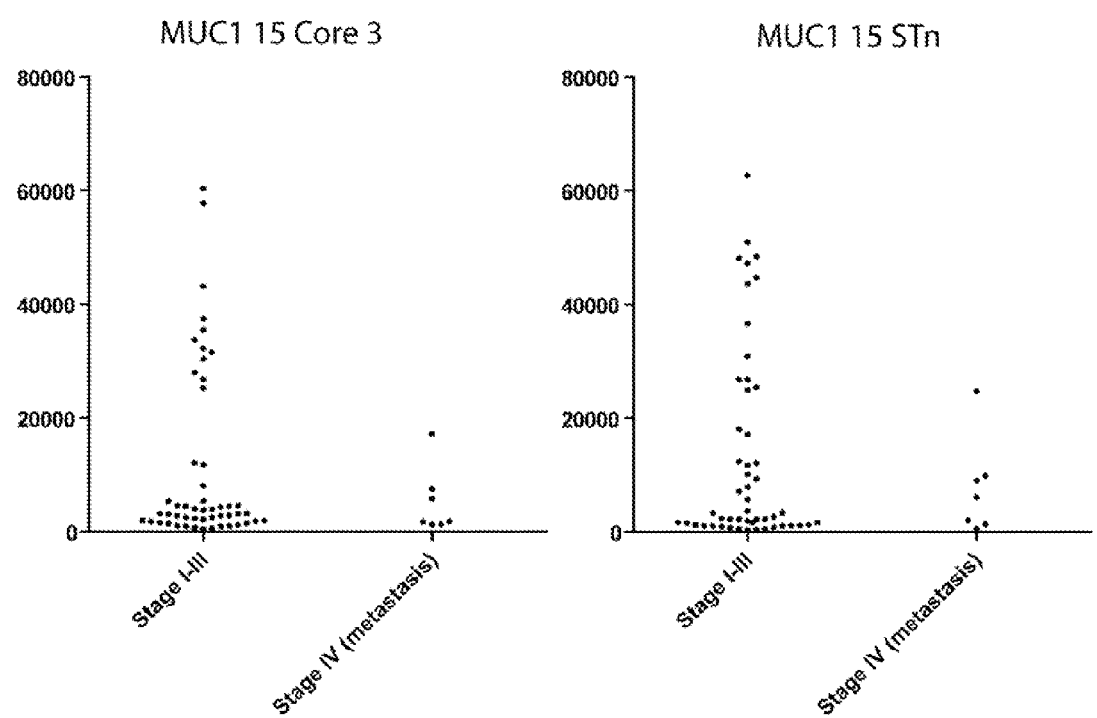

The rather large difference in the auto-antibody levels between patients is noteworthy and indicates important biological variations in auto-antibody production and responses in cancer patients. First, interpersonal variations in the amount of expressed antigen (glycan-MUC1) could vary in colorectal cancer. However, using Tn/STn-MUC1 specific antibodies the inventors found that 92% (23/25) of the examined patients express Tn/STn-MUC1. In contrast only 50% of the patients have STn-MUC1 antibodies. Additional explanations therefore exist for the variations in auto-antibody levels. Among these, the subject's ability to recognise and present STn- and Core3-MUC1 could be important. In order to test if patients with high levels of auto-antibodies corresponded to patients in which peripheral T cell response could be identified, the inventors isolated T-cells from 15 selected colon cancer patients. Furthermore, variance in local stromal factors such as the secretion of TGF beta among other factors are known to down-regulate the immune-response to cancer targets causing immunological escape (Tinder, Subramani et al. 2008). This is a possible explanation to the lack of selected immunological reaction such as anti-STn-MUC1 in some individuals. Finally, many of these patients could be immuno-compromised due to the progression of their disease. In this respect the inventors detected a deterioration of both the Core-3-MUC1 and STn-MUC1 response in later stage cancers with liver metastasis (FIG. 3C). This could reflect the immuno-compromised state of the patients or changes in expression of the antigen. Alternatively, the decrease in serum antibodies in late stage cancers is due to chelation of circulating antibodies by large tumour and metastasis mass along with the possibility of immune-complex formation, which would render the antibodies undetectable. In summary, the results show that the method of the present invention is useful in detecting cancer at an early stage.

The immunogenic nature of MUC1 provides an explanation for MUC1 glycopeptide responses in cancers other than gastrointestinal cancers, such as breast, ovarian, and prostate cancer. In these patients, however, only few have circulating MUC1 auto-antibodies.

In one embodiment the cancer detected or treated by the present invention is colorectal cancer.

In one embodiment the at least two different O-glycosylated peptides of the method of the present invention as defined herein above comprises at least 5 consecutive amino acid residues of a mucin selected from the group consisting of MUC1 Variant CT58, MUC1 Variant CT80, MUC1 Variant SEC, MUC1 Variant X, MUC1 Variant Y, MUC1 Variant ZD, MUC2, MUC3A, MUC3B, MUC4, MUC5AC, MUC5B, MUC6, MUC7, MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin. In one embodiment the O-glycosylated peptide of the method of the present invention is not a MUC2 peptide.

In one embodiment the at least 5 consecutive amino acid residues of a mucin is/are selected from the group consisting of MUC1 Variant CT58, MUC1 Variant CT80, MUC1 Variant SEC, MUC1 Variant X, MUC1 Variant Y, MUC1 Variant ZD, MUC2, MUC3A, MUC3B, MUC4, MUC5AC, MUC5B, MUC6, MUC7, MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin are selected from the group consisting of PMTDTKTVTTPGSSFTA (SEQ ID NO: 3), PGSSFTASGHSPSEIVPQD (SEQ ID NO: 4), SEIVPQDAPTISAATTFAPA (SEQ ID NO: 5), TTFAPAPT-GNGHTTQAPTTA (SEQ ID NO: 6), TTQAPT-TALQAAPSSHD (SEQ ID NO: 7), APSSHDATLGPSGGT-SLSKT (SEQ ID NO: 8), SLSKTGALTLANSVVSTP (SEQ ID NO: 9), NSVVSTPGGPEGQWTSASAS (SEQ ID NO: 10), TSASASTSPRTAAAMTHT (SEQ ID NO: 11), AAAMTHTHQAESTEASGQT (SEQ ID NO: 12), EAS-GQTQTSEPASSGSRTT (SEQ ID NO: 13), PASSGSRTT-SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), STGDTLPLPVTDTSSV (SEQ ID NO: 22), PVTYASSASTGDTTPLPVTDTSSVSTGHAT (SEQ ID NO: 23), VTSAPDTRPAPGSTAPPAHG (SEQ ID NO: 24), and PTTTPITTTTVTPTPTPTGTQTPTTTPISTTC (SEQ ID NO:25), or a fragment of said peptides, or variants of said peptides in which variants any amino acid has been changed to a different amino acid, provided that no more than 5 of the amino acid residues in the sequence are so changed.

In one embodiment of the method of the present invention as defined herein, the at least two O-glycosylated peptides are a first and a second O-glycosylated mucin peptide wherein the first O-glycosylated mucin peptide is selected from the group consisting of VTSAPDT(Core3)RPAPG-STAPPAHG (MUC1 Core3), VT(Core3)SAPDTRPAPGS (Core3)T(Core3)APPAHG (MUC1 9Core3), VT(Core3)S (Core3)APDT(Core3)RPAPGS(Core3)T(Core3)APPAHG (MUC1-15Core3), VT(STn)S(STn)APDT(STn)RPAPGS (STn)T(STn)APPAHG (MUC 1 (15STn), VT(STn)SAP-DTRPAPGS(STn)T(STn)APPAHG (MUC1 9STn), VT(Tn) S(Tn)APDT(Tn)RPAPGS(Tn)T(Tn)APPAHG (MUC1 15Tn), VT(Tn)SAPDTRPAPGS(Tn)T(Tn)APPAHG (MUC1 9Tn), VT(Tn)SAPDTRPAPGST(Tn)APPAHG (MUC1 6Tn), and the second O-glycosylated mucin peptide is selected from the group consisting of: PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S* AS*T*GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23) PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr) and ST/sialyl-T (Neu5Acα2-3Galβ3GalNAc-Ser/Thr).

In principle the peptides of the invention may be glycosylated by any physiological O-glycan at a potential O-glycosylation site. Thus, in one embodiment the optional glycan is Core-3 (GlcNAcβ1-3GalNAc-α-Ser/Thr). In another embodiment the optional glycan is Tn (GalNAc-α-Ser/Thr). In yet another embodiment the optional glycan is STn/sialyl-Tn (Neu5Acα2-6GalNAc-α-Ser/Thr). In yet another embodiment the optional glycan is Core-2 (Galβ1-3 (GlcNAcβ1-6)GalNAc-α-Ser/Thr)). In another embodiment the optional glycan is a Core-4 (GlcNAcβ1-3(GlcNAcβ1-6)GalNAc-α-Ser/Thr). In yet another embodiment the optional glycan is ST/sialyl-T (Neu5Acα2-3Galβ3GalNAc-Ser/Thr).

In one embodiment of the present invention the at least two different O-glycosylated peptides are at least three different O-glycosylated peptides selected from the group consisting of: VT*S*APDT*RPAPGS*T*APPAHG (SEQ ID NO: 24), PT*T*T*PIT*T*T*T*T*VT*PT*PT*PT*GT* QT*PT*T*T*PIS*T*T*C (SEQ ID NO: 25), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S* AS*T*GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23) PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr) and ST/sialyl-T (Neu5Acα2-3Galβ3GalNAc-Ser/Thr)

In one embodiment of the present invention the at least two different O-glycosylated peptides are at least four different O-glycosylated peptides selected from the group consisting of: VT*S*APDT*RPAPGS*T*APPAHG (SEQ ID NO: 24), PT*T*T*PIT*T*T*T*T*VT*PT*PT*PT*GT*QT* PT*T*T*PIS*T*T*C (SEQ ID NO: 25), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO:

11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)), Core-4 (GlcNAcβ1-3(GlcNAcβ1-6)GalNAc-α-Ser/Thr) and ST/sialyl-T (Neu5Acα2-3Galβ3GalNAc-Ser/Thr).

In one embodiment of the present invention the at least two different O-glycosylated peptides are five or more different O-glycosylated peptides selected from the group consisting of: VT*S*APDT*RPAPGS*T*APPAHG (SEQ ID NO: 24), PT*T*T*PIT*T*T*T*T*VT*PT*PT*PT*GT*QT*PT*T*T*PIS*T*T*C (SEQ ID NO: 25), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*A S*T*GH (SEQ ID NO: 19), LPVT*S*PS*S*AS*T*GHAS*PLLVT*DAS*S* AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)), Core-4 (GlcNAcβ1-3(GlcNAcβ1-6)GalNAc-α-Ser/Thr) and ST/sialyl-T (Neu5Acα2-3Galβ3GalNAc-Ser/Thr)

In one embodiment the five or more different O-glycosylated peptides are six or more O-glycosylated peptides, such as seven or more O-glycosylated peptides, for example eight or more O-glycosylated peptides, such as nine or more O-glycosylated peptides, for example ten or more O-glycosylated peptides, such as eleven or more O-glycosylated peptides, for example twelve or more O-glycosylated peptides, such as 13 or more O-glycosylated peptides.

An object of the present invention is to use the general method defined above for detecting specific disorders characterised in that autoantibodies are produced by the individual suffering from said disease. One such disease is cancer. An individual afflicted with cancer significantly benefits from an early stage diagnosis.

Accordingly, in one aspect the present invention relates to a method for detecting cancer, said method comprising (i) contacting a sample with one or more O-glycosylated mucin peptides, wherein said peptide is selected from the group consisting of:
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23), VT*S*APDT*RPAPGS*T*APPAHG (SEQ ID NO: 24), PT*T*T*PIT*T*T*T*T*VT*PT*PT*PT*GT*QT*PT*T*T*PIS*T*T*C (SEQ ID NO: 25) and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*

EAS*GQT*QT*S*EPAS*S*GS*RT*T*
S*AGT*AT*PS*S*S*GAS*GT*T*PS*GS*EGIS*T*S*
GET*T*RFS*S*NPS*RDS*HT*T* (SEQ ID NO: 30), or a fragment of said peptides, or variants of said peptides in which variants any amino acid has been changed to a different amino acid, provided that no more than 5 of the amino acid residues in the sequence are so changed, and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)), Core-4 (GlcNAcβ1-3(GlcNAcβ1-6)GalNAc-α-Ser/Thr) and ST/sialyl-T (Neu5Acα2-3Galβ3GalNAc-Ser/Thr) and (ii) removing unbound sample, and (iii) qualitatively and/or quantitatively characterise the bound material, wherein antibodies bound to said peptides indicate cancer in the sample host.

The glycosylated peptides of the present invention preferably comprises at least 5 amino residues. In one aspect the present invention relates to a method for detecting cancer, said method comprising (i) contacting a sample with one or more O-glycosylated mucin peptides, wherein said peptide comprises at least 5, such as at least 8, e.g. at least 10, such as at least 15 consecutive amino acid residues of a mucin selected from the group consisting of MUC4 (SEQ ID NO: 1) and/or MUC1 (SEQ ID NO: 2), or a fragment or variant thereof, wherein said variant is at least 70%, for example at least 75%, such as at least 80%, for example at least 85%, such as at least 90%, for example at least 95%, such as at least 98%, for example at least 99% identical to said at least 5 consecutive amino acid residues of said mucin selected from the group consisting of MUC4 (SEQ ID NO: 1) and/or MUC1 (SEQ ID NO: 2), and (ii) removing unbound sample, and (iii) qualitatively and/or quantitatively characterise the bound material, wherein antibodies bound to said peptides indicate cancer in the sample host.

The peptides of the invention may be produced either by digesting full length or truncated mucin polypeptides or by automated peptide synthesis. The peptides are then optionally glycosylated. These methods are known to those skilled in the art.

In one aspect the present invention relates to a method for detecting cancer, said method comprising (i) contacting a sample with one or more mucin peptides, wherein said peptide is selected from the group consisting of:

a) MUC4 Tn selected from the group consisting of
PVT*S*PS*S*AS*T*GHT*T*PLPVT*DT*S*S*AS*T*GDT*T*P (SEQ ID NO: 18),
LPVT*S*LS*S*VS*T*GDT*T*PLPVT*S*PS*S*AS*T*GH (SEQ ID NO: 19),
LPVT*S*PS*S*AS*T*GHAS*PLLVT*DAS*S*AS*T*GQ (SEQ ID NO: 20),
PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and
PVT*YAS*S*AS*T*GDT*T*PLPVT*DT*S*S*VS*T*GHAT* (SEQ ID NO: 23), wherein the asterisk (*) indicates a potential O-glycosylation site, wherein the optional glycan is Tn (GalNAc-α-Ser/Thr), or b) a MUC4 non glycosylated mucin peptide selected from the group consisting of
PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSAS-TGQ (SEQ ID NO: 20), PLPVTSPSSASTGHASPLLVT-DASSASTGQ (SEQ ID NO: 21) STGDTLPLPVTDTSSV (SEQ ID NO: 22), PVTYASSASTGDTTPLPVTDTSSVST-GHAT (SEQ ID NO: 23), or a Tn glycosylated mucin peptide selected from the group consisting of
PVT*S*PS*S*AS*T*GHT*T*PLPVT*DT*S*S*AS*T*GDT*T*P (SEQ ID NO: 18),
LPVT*S*LS*S*VS*T*GDT*T*PLPVT*S*PS*S*AS*T*GH (SEQ ID NO: 19),
LPVT*S*PS*S*AS*T*GHAS*PLLVT*DAS*S*AS*T*GQ (SEQ ID NO: 20),
PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and
PVT*YAS*S*AS*T*GDT*T*PLPVT*DT*S*S*VS*T*GHAT* (SEQ ID NO: 22), wherein the asterisk (*) indicates a potential O-glycosylation site, wherein the optional glycan is Tn (GalNAc-α-Ser/Thr), or c) a Tn glycosylated MUC4 peptide selected from the group consisting of
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID15 NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates a potential O-glycosylation site, wherein the optional glycan is Tn (GalNAc-α-Ser/Thr), or d) an all-Tn MUC4 peptide selected from the group consisting of
PVT*S*PS*S*AS*T*GHT*T*PLPVT*DT*S*S*AS*T*GDT*T*P (SEQ ID NO: 18),
LPVT*S*LS*S*VS*T*GDT*T*PLPVT*S*PS*S*AS*T*GH (SEQ ID NO: 19),
LPVT*S*PS*S*AS*T*GHAS*PLLVT*DAS*S*AS*T*GQ (SEQ ID NO: 20), S*T*GDT*LPLPVT*DT*S*S*V (SEQ ID NO: 22),
PVT*YAS*S*AS*T*GDT*T*PLPVT*DT*S*S*VS*T*GHAT* (SEQ ID NO: 23) and
PMT*DT*KTV*T*T*PGS*S*FT*AS*GHS*PS*EIVPQ DAPT*IS*AAT*ZFAPAPT*GNGHT*
T*QAPT*T*ALQAAPS*S*HDAT*LGPS*GGT*S*LS*
KT*GALT*LANS*VVS*T*PGGPEG
QWT*S*AS*AS*T*S*PDT*AAAMT*HT*HQAES*T*
EAS*GQT*QT*S*EPAS*S*GS*RT*T*
S*AGT*AT*PS*S*S*GAS*GT*T*PS*GS*EGIS*T*S*
GET*T*RFS*S*NPS*RDS*HT*T* (SEQ ID NO: 30),
PMT*DT*KT*VT*T*PGS*S*FT*A (SEQ ID NO:3),
PGS*S*FT*AS*GHS*PS*EIVPQD (SEQ ID NO: 4),
S*EIVPQDAPT*IS*AAT*T*FAPA (SEQ ID NO: 5),
T*T*FAPAPT*GNGHT*T*QAPT*T*A (SEQ ID NO: 6),
T*T*QAPT*T*ALQAAPS*S*HD(SEQ ID NO:7),
APS*S*HDAT*LGPS*GGT*S*LS*KT* (SEQ ID NO:8),
S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates an O-glycosylation site, wherein the glycan is Tn (GalNAc-α-Ser/Thr), or
e) a recombinant MUC4 Tn having the sequence
PMT*DT*KTV*T*T*PGS*S*FT*AS*GHS*PS*EIVPQ
DAPT*IS*AAT*ZFAPAPT*GNGHT*
T*QAPT*T*ALQAAPS*S*HDAT*LGPS*GGT*S*LS*
KT*GALT*LANS*VVS*T*PGGPEG
QWT*S*AS*AS*T*S*PDT*AAAMT*HT*HQAES*T*
EAS*GQT*QT*S*EPAS*S*GS*RT*T*
S*AGT*AT*PS*S*S*GAS*GT*T*PS*GS*EGIS*T*S*
GET*T*RFS*S*NPS*RDS*HT*T* (SEQ ID NO: 30), wherein the asterisk (*) indicates a potential O-glycosylation site, wherein the optional glycan is Tn (GalNAc-α-Ser/Thr), or
f) a MUC1Tn/STn/Core3 glycosylated or MUC4 glycosylated mucin peptide selected from the group consisting of
VT(Tn)S(Tn)APDT(Tn)RPAPGS(Tn)T(Tn)APPAHG,
VT(STn)S(STn)APDT(STn)RPAPGS(STn)T(STn)APPAHG, VT(Core3)S(Core3)APDT(Core3)RPAPGS(Core3)T(Core3)APPAHG,
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23),
and
PMT*DT*KTV*T*T*PGS*S*FT*AS*GHS*PS*EIVPQ
DAPT*IS*AAT*ZFAPAPT*GNGHT*
T*QAPT*T*ALQAAPS*S*HDAT*LGPS*GGT*S*LS*
KT*GALT*LANS*VVS*T*PGGPEG
QWT*S*AS*AS*T*S*PDT*AAAMT*HT*HQAES*T*
EAS*GQT*QT*S*EPAS*S*GS*RT*T*
S*AGT*AT*PS*S*S*GAS*GT*T*PS*GS*EGIS*T*S*
GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), or g) a MUC1 STn and a MUC4 selected from the group consisting of
VT(STn)S(STn)APDT(STn)RPAPGS(STn)T(STn)APPAHG,
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and
(ii) removing unbound sample, and
(iii) qualitatively and/or quantitatively characterise the bound material, wherein antibodies bound to said peptides indicate cancer in the sample host.

In one embodiment the cancer detected by the method of the present invention is selected from the group consisting of colorectal cancer, breast cancer, oral cancer, gastric cancer, esophageal cancer, pancreatic cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

In one embodiment the detected cancer is colorectal cancer.

In one aspect the present invention relates to a method for detecting colorectal cancer in a host organism, said method comprising
(i) contacting a sample from said host organism with one or more O-glycosylated mucin peptides, wherein said peptide is selected from the group consisting of:
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23), VT*S*APDT*RPAPGS*T*APPAHG (SEQ ID NO: 24), PT*T*T*PIT*T*T*T*T*VT*PT*PT*PT*GT*QT*PT*T*T*PIS*T*T*C (SEQ ID NO: 25) and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEGQWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), or a fragment of said peptides, or variants of said peptides in which variants any amino acid has been changed to a different amino acid, provided that no more than 5 of the amino acid residues in the sequence are so changed, and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and (ii) removing unbound sample, and (iii) qualitatively and/or quantitatively characterise the bound material, wherein antibodies bound to said peptides indicate cancer in the sample host.

As demonstrated in table II of the present application, and as discussed herein above, it may be useful to utilise one or more, such as two different O-glycosylated peptides for detecting colorectal cancer, and for distinguishing between colorectal cancer and inflammatory bowel disease.

Thus, in one aspect the present invention relates to a method for detecting colorectal cancer in a sample host, said method comprising (i) contacting a sample from said sample host with one or more mucin peptides, wherein said peptide is selected from the group consisting of:

a) MUC4 Tn selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), wherein the asterisk (*) indicates a potential O-glycosylation site, wherein the optional glycan is Tn (GalNAc-α-Ser/Thr), or b) a MUC4 non glycosylated mucin peptide selected from the group consisting of PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21) STGDTLPLPVTDTSSV (SEQ ID NO: 22), PVTYASSASTGDTTPLPVTDTSSVST- GHAT (SEQ ID NO: 23), or a Tn glycosylated mucin peptide selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 22), wherein the asterisk (*) indicates a potential O-glycosylation site, wherein the optional glycan is Tn (GalNAc-α-Ser/Thr), or c) a Tn glycosylated MUC4 peptide selected from the group consisting of PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID15 NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates a potential O-glycosylation site, wherein the optional glycan is Tn (GalNAc-α-Ser/Thr), or d) an all-Tn MUC4 peptide selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEGQWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates an O-glycosylation site, wherein the glycan is Tn (GalNAc-α-Ser/Thr), or e) a recombinant MUC4 Tn having the sequence PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is Tn (GalNAc-α-Ser/Thr), or f) a MUC1Tn/STn/Core3 glycosylated or MUC4 glycosylated mucin peptide selected from the group consisting of VT(Tn)S(Tn)APDT(Tn)RPAPGS(Tn)T(Tn)APPAHG, VT(STn)S(STn)APDT(STn)RPAPGS(STn)T(STn) APPAHG, VT(Core3)S(Core3)APDT(Core3)RPAPGS (Core3)T(Core3)APPAHG,
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S* AS*T*GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23),
and
PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr), and ST/sialyl-T (Neu5Acα2-3Galβ3GalNAc-Ser/Thr), or g) a MUC1 STn and a MUC4 selected from the group consisting of
VT(STn)S(STn)APDT(STn)RPAPGS(STn)T(STn) APPAHG,
PVT*S*PS*S*AS*T*GHT*T*PLPVT*DT*S*S*AS*T* GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T* GHAT* (SEQ ID NO: 23), and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and (ii) removing unbound sample, and (iii) qualitatively and/or quantitatively characterise the bound material, wherein antibodies bound to said peptides indicate cancer in the sample host.

In a further aspect the invention relates to a method for detecting colorectal cancer in a host organism, said method comprising (i) contacting a sample from said host organism with at least two different O-glycosylated peptides, and (ii) removing unbound sample, and (iii) qualitatively and/or quantitatively characterise the bound material, wherein antibodies bound to the peptides of step (i) are indicative of disease or disorder in the host organism.

In principle, any suitable O-glycosylated peptide can be used for detecting auto-antibodies binding to this glycosylated peptide epitope. It is preferred that the peptide epitope comprises at least 5 amino acid residues.

In one aspect the present invention thus relates to a method for detecting colorectal cancer in a host organism, said method comprising (i) contacting a sample from said host organism with one or more O-glycosylated peptides, wherein said peptide comprises at least 5 consecutive amino acid residues of a mucin selected from the group consisting of MUC4 (SEQ ID NO: 1), MUC1 (SEQ ID NO: 2), MUC1 Variant CT58, MUC1 Variant CT80, MUC1 Variant SEC, MUC1 Variant X, MUC1 Variant Y, MUC1 Variant ZD, MUC2 (SEQ ID NO: 26), MUC3A, MUC3B, MUC4, MUC5AC (SEQ ID NO: 27), MUC5B, MUC6 (SEQ ID NO: 28), and MUC7 (SEQ ID NO: 29), MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin, or a naturally occurring fragment or variant of said mucin, wherein said variant is at least 70% identical to said at least 5 consecutive amino acid residues of said mucin, and (ii) removing unbound sample, and (iii) qualitatively and/or quantitatively characterise the bound material, wherein antibodies bound to said peptides indicate cancer in the sample host.

In one embodiment said O-glycosylated mucin peptide is selected from the group consisting of PVTSPSSAST-GHTTPLPVTDTSSASTGDTTP (SEQ ID NO: 18), LPVT- SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), STGDTLPLPVTDTSSV (SEQ ID NO: 22) and PVTYASSASTGDTTPLPVTDTSSVSTGHAT (SEQ ID NO: 23).

In another embodiment said O-glycosylated mucin peptide is a MUC4 selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), wherein the asterisk (*) indicates a potential O-glycosylation site, wherein the optional glycan is selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

In another embodiment said O-glycosylated mucin peptide is a MUC4 Tn selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), wherein the asterisk (*) indicates a potential O-glycosylation site, wherein the optional glycan is Tn (GalNAc-α-Ser/Thr).

In another embodiment said O-glycosylated mucin peptide is a MUC4 non glycosylated or Tn glycosylated mucin selected from the group consisting of PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), STGDTLPLPVTDTSSV (SEQ ID NO: 22) and PVTYASSASTGDTTPLPVTDTSSVSTGHAT (SEQ ID NO: 23), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), wherein the asterisk (*) indicates a potential O-glycosylation site, wherein the glycan is Tn (GalNAc-α-Ser/Thr).

In another embodiment said O-glycosylated mucin peptide is a MUC4 fragment Tn selected from the group consisting of PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID15 NO: 15), GS*EGIS*T*S*GET*T*RFS*S*N (SEQ ID NO: 16), GET*T*RFS*S*NPS*RDS*HT*T* (SEQ ID NO: 17), wherein the asterisk (*) indicates a potential O-glycosylation site, wherein the optional glycan is a Tn (GalNAc-α-Ser/Thr).

In another embodiment said O-glycosylated mucin peptide is an all-Tn MUC4 peptide selected from the group consisting of PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEGQWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates a potential O-glycosylation site, wherein the optional glycan is Tn (GalNAc-α-Ser/Thr).

In another embodiment the at least two different O-glycosylated mucin peptides are a first O-glycosylated mucin peptide selected from the group consisting of PMTDTKTVTTPGSSFTA (SEQ ID NO: 3), PGSSFTASGHSPSEIVPQD (SEQ ID NO: 4), SEIVPQDAPTISAAT-TFAPA (SEQ ID NO: 5), TTFAPAPTGNGHTTQAPTTA (SEQ ID NO: 6), TTQAPTTALQAAPSSHD (SEQ ID NO: 7), APSSHDATLGPSGGTSLSKT (SEQ ID NO: 8), SLSKTGALTLANSVVSTP (SEQ ID NO: 9), NSVVSTPGGPEGQWTSASAS (SEQ ID NO: 10), TSASAST-SPRTAAAMTHT (SEQ ID NO: 11), AAAMTHTHQAESTEASGQT (SEQ ID NO: 12), EASGQTQTSEPASSGSRTT (SEQ ID NO: 13), PASSGSRTT- SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), PVTYASSASTGDTTPLPVTDTSSVSTGHAT (SEQ ID NO: 22), STGDTLPLPVTDTSSV (SEQ ID NO: 23) and a second O-glycosylated mucin peptide selected from the group consisting of VTSAPDT(Core3)RPAPG-STAPPAHG (MUC1 Core3), VT(Core3)SAPDTRPAPGS(Core3)T(Core3)APPAHG (MUC1 9Core3), VT(Core3)S(Core3)APDT(Core3)RPAPGS(Core3)T(Core3)APPAHG (MUC1-15Core3), VT(STn)S(STn)APDT(STn)RPAPGS(STn)T(STn)APPAHG (MUC 1 (15STn), VT(STn)SAP-DTRPAPGS(STn)T(STn)APPAHG (MUC1 9STn), VT(Tn)S(Tn)APDT(Tn)RPAPGS(Tn)T(Tn)APPAHG (MUC1 15Tn), VT(Tn)SAPDTRPAPGS(Tn)T(Tn)APPAHG (MUC1 9Tn), VT(Tn)SAPDTRPAPGST(Tn)APPAHG (MUC1 6Tn) respectively, wherein said first O-glycosylated mucin peptide is glycosylated on one or more Thr or Ser residues and wherein said glycosylation is
(ii) removing unbound sample, and
(iii) qualitatively and/or quantitatively characterise the bound material, wherein antibodies bound to said peptides indicate cancer in the sample host.

In another embodiment, wherein the one or more O-glycosylated mucin peptides and/or the two or more O-glycosylated mucin peptides as defined anywhere in the present application, are a first O-glycosylated mucin peptide and a second O-glycosylated mucin peptide wherein said first O-glycosylated mucin peptide is a MUC1-0-glycosylated mucin peptide and wherein said second O-glycosylated mucin peptide is a MUC4 O-glycosylated mucin peptide.

In another embodiment said MUC1 O-glycosylated mucin peptide is a MUC1STn and/or MUC1Tn and/or MUC1Core3 O-glycosylated mucin peptide selected from the group consisting of VT(Tn)S(Tn)APDT(Tn)RPAPGS(Tn)T(Tn)APPAHG, VT(STn)S(STn)APDT(STn)RPAPGS(STn)T(STn)APPAHG, VT(Core3)S(Core3)APDT(Core3)RPAPGS(Core3)T(Core3)APPAHG, and wherein said MUC4 O-glycosylated mucin peptide is selected from the group consisting of
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), wherein the asterisk (*) indicates a potential O-glycosylation site, wherein the glycan is independently and optionally selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

In one aspect the present invention relates to a method for detecting colorectal cancer, said method comprising:
(i) contacting a sample with one or more O-glycosylated MUC1 peptides and optionally at least one second mucin peptide wherein the O-glycosylated MUC1 peptides are selected from the group consisting of VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3)RPAPGS(Core3)T(Core3)APPAHG (MUC1-15Core3), VT(STn)S(STn)APDT(STn)RPAPGS(STn)T(STn)APPAHG (MUC 1 (15STn), VT(STn)SAPDTRPAPGS(STn)T(STn)APPAHG (MUC1 9STn), VT(Tn)S(Tn)APDT(Tn)RPAPGS(Tn)T(Tn)APPAHG (MUC1 15Tn), VT(Tn)SAPDTRPAPGS(Tn)T(Tn)APPAHG (MUC1 9Tn), VT(Tn)SAPDTRPAPGST(Tn)APPAHG (MUC1 6Tn) and wherein said at least one second mucin peptide optionally is/are selected from:
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) and PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*

KT*GALT*LANS*VVS*T*PGGPEG
QWT*S*AS*AS*T*S*PDT*AAAMT*HT*HQAES*T*
EAS*GQT*QT*S*EPAS*S*GS*RT*T*
S*AGT*AT*PS*S*S*GAS*GT*T*PS*GS*EGIS*T*S*
GET*T*RFS*S*NPS*RDS*HT*T* (SEQ ID NO: 30), and
(ii) removing unbound sample, and
(iii) qualitatively and/or quantitatively characterise the bound material, wherein antibodies bound to said peptides indicate cancer in the sample host.

The peptide can be any peptide sharing a significant sequence identity with the peptides specified herein above, or a peptide sharing secondary or tertiary structure with the present peptides. Thus, in a further aspect the present invention relates to a method for detecting colorectal cancer in a host organism, said method comprising
(i) contacting a sample from said host organism with one or more O-glycosylated mucin peptides, wherein said peptide comprises, or said peptides comprise, at least 5 consecutive amino acid residues of a mucin, or a fragment or variant thereof, wherein said variant is at least 70% identical, such as at least 75% identical to, e.g. at least 80% identical to, such as at least 85% identical to, e.g. at least 90% identical to, such as at least 95% identical to, e.g. at least 98% identical to, such as at least 99% identical to said at least 5 consecutive amino acid residues of said mucin, and
(ii) removing unbound sample, and
(iii) qualitatively and/or quantitatively characterise the bound material, wherein antibodies bound to said peptides indicate cancer in the host organism.

All mucin peptides defined herein above may occur as tandem repeats. Thus in one embodiment, the glycopeptide of the present invention is a tandem repeat peptide. In one embodiment the number of repeats is two. In another embodiment the number of repeats is three. In yet another embodiment the number of repeats is four. In yet another embodiment the number of repeats is five or more, such as six, for example seven, such as eight, for example nine, such as ten, for example eleven, such as 12, for example 13, such as 14, for example 15, such as 16, for example 17, such as 18, for example 19, such as 20, for example 21, such as 22, for example 23, such as 24, for example 25, such as 26, for example 27, such as 28, for example 29, such as 30, for example 31, such as 32, for example 33, such as 34, for example 35, such as 36, for example 37, such as 38, for example 39, such as 40, for example 41, such as 42, for example 43, such as 44, for example 45, such as 46, for example 47, such as 48, for example 49, such as 50 or more.

The term variant as used herein should be understood as functional equivalent and can be used interchangeably. In one preferred embodiment of the invention there is also provided variants of the mucin glycopeptides and variants or fragments thereof. When being polypeptides, variants are determined on the basis of their degree of identity or their homology with a predetermined amino acid sequence, said predetermined amino acid sequence being one of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO: 29 and SEQ ID NO: 30, or, when the variant is a fragment, a fragment of any of the aforementioned amino acid sequences, respectively.

Accordingly, variants preferably have at least 75% sequence identity, for example at least 80% sequence identity, such as at least 85% sequence identity, for example at least 90% sequence identity, such as at least 91% sequence identity, for example at least 91% sequence identity, such as at least 92% sequence identity, for example at least 93% sequence identity, such as at least 94% sequence identity, for example at least 95% sequence identity, such as at least 96% sequence identity, for example at least 97% sequence identity, such as at least 98% sequence identity, for example 99% sequence identity with the predetermined sequence.

Sequence identity is determined in one embodiment by utilising fragments of the glycosylated peptides comprising at least 5 contiguous amino acids and having an amino acid sequence which is at least 80%, such as 85%, for example 90%, such as 95%, for example 99% identical to the amino acid sequence of any of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO: 29 or SEQ ID NO: 30, respectively, wherein the percent identity is determined with the algorithm GAP, BESTFIT, or FASTA in the Wisconsin Genetics Software Package Release 7.0, using default gap weights.

Optimal alignment of sequences for aligning a comparison window may be conducted by the local homology algorithm of Smith and Waterman (1981) Adv. Appl. Math. 2: 482, by the homology alignment algorithm of Needleman and Wunsch (1970) J. Mol. Biol. 48: 443, by the search for similarity method of Pearson and Lipman (1988) Proc. Natl. Acad. Sci. (U.S.A.) 85: 2444, by computerized implementations of these algorithms (GAP, BESTFIT, FASTA, and TFASTA in the Wisconsin Genetics Software Package Release 7.0, Genetics Computer Group, 575 Science Dr., Madison, Wis.), or by inspection, and the best alignment (i.e., resulting in the highest percentage of homology over the comparison window) generated by the various methods is selected.

The term "sequence identity" means that two peptide or polypeptide sequences are identical (i.e., on an amino acid to amino acid basis) over the window of comparison. The term "percentage of sequence identity" is calculated by comparing two optimally aligned sequences over the window of comparison, determining the number of positions at which the identical amino acid (e.g., A, G, T, S etc.) occurs in both sequences to yield the number of matched positions, dividing the number of matched positions by the total number of positions in the window of comparison (i.e., the window size), and multiplying the result by 100 to yield the percentage of sequence identity. The terms "substantial identity" as used herein denotes a characteristic of a peptide or polypeptide sequence, wherein the peptide or polypeptide sequence comprises a sequence that has at least 85 percent sequence identity, preferably at least 90 to 95 percent sequence identity, more usually at least 99 percent sequence identity as compared to a predetermined sequence over a comparison window of at least 20 amino acid positions, wherein the percentage of sequence identity is calculated by comparing the predetermined sequence to the peptide or polypeptide sequence which may include deletions or additions which total 20 percent or less of the predetermined sequence over the window of comparison. The predetermined sequence may be a subset of a larger sequence, for example, as a segment of the full-length mucin polypeptide sequences illustrated herein.

Furthermore, a degree of identity of amino acid sequences is a function of the number of identical amino acids at positions shared by the amino acid sequences. A degree of homology or similarity of amino acid sequences is a function of the number of amino acids, i.e. structurally related, at positions shared by the amino acid sequences.

An "unrelated" or "non-homologous" sequence shares less than 40% identity, though preferably less than 25% identity, with one of the peptide or polypeptide sequences of the present invention. The term "substantial identity" means that two peptide sequences, when optimally aligned, such as by the programs GAP or BESTFIT using default gap weights, share at least 80 percent sequence identity, preferably at least 90 percent sequence identity, more preferably at least 95 percent sequence identity or more (e.g., 99 percent sequence identity). Preferably, residue positions which are not identical differ by conservative amino acid substitutions.

Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine, a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, and asparagine-glutamine.

Additionally, variants are also determined based on a predetermined number of conservative amino acid substitutions as defined herein below. Conservative amino acid substitution as used herein relates to the substitution of one amino acid (within a predetermined group of amino acids) for another amino acid (within the same group), wherein the amino acids exhibit similar or substantially similar characteristics.

Within the meaning of the term "conservative amino acid substitution" as applied herein, one amino acid may be substituted for another within the groups of amino acids indicated herein below:
i) Amino acids having polar side chains (Asp, Glu, Lys, Arg, His, Asn, Gln, Ser, Thr, Tyr, and Cys,)
ii) Amino acids having non-polar side chains (Gly, Ala, Val, Leu, Ile, Phe, Trp, Pro, and Met)
iii) Amino acids having aliphatic side chains (Gly, Ala Val, Leu, Ile)
iv) Amino acids having cyclic side chains (Phe, Tyr, Trp, His, Pro)
v) Amino acids having aromatic side chains (Phe, Tyr, Trp)
vi) Amino acids having acidic side chains (Asp, Glu)
vii) Amino acids having basic side chains (Lys, Arg, His)
viii) Amino acids having amide side chains (Asn, Gln)
ix) Amino acids having hydroxy side chains (Ser, Thr)
x) Amino acids having sulphur-containing side chains (Cys, Met),
xi) Neutral, weakly hydrophobic amino acids (Pro, Ala, Gly, Ser, Thr)
xii) Hydrophilic, acidic amino acids (Gln, Asn, Glu, Asp), and
xiii) Hydrophobic amino acids (Leu, Ile, Val)

Accordingly, a variant or a fragment thereof according to the invention may comprise, within the same variant of the sequence or fragments thereof, or among different variants of the sequence or fragments thereof, at least one substitution, such as a plurality of substitutions introduced independently of one another.

It is clear from the above outline that the same variant or fragment thereof may comprise more than one conservative amino acid substitution from more than one group of conservative amino acids as defined herein above.

The addition or deletion of at least one amino acid may be an addition or deletion of from preferably 2 to 250 amino acids, such as from 10 to 20 amino acids, for example from 20 to 30 amino acids, such as from 40 to 50 amino acids. However, additions or deletions of more than 50 amino acids, such as additions from 50 to 100 amino acids, addition of 100 to 150 amino acids, addition of 150-250 amino acids, are also comprised within the present invention. The deletion and/or the addition may—independently of one another—be a deletion and/or an addition within a sequence and/or at the end of a sequence.

The polypeptide fragments according to the present invention, including any functional equivalents thereof, may in one embodiment comprise less than 250 amino acid residues, such as less than 240 amino acid residues, for example less than 225 amino acid residues, such as less than 200 amino acid residues, for example less than 180 amino acid residues, such as less than 160 amino acid residues, for example less than 150 amino acid residues, such as less than 140 amino acid residues, for example less than 130 amino acid residues, such as less than 120 amino acid residues, for example less than 110 amino acid residues, such as less than 100 amino acid residues, for example less than 90 amino acid residues, such as less than 85 amino acid residues, for example less than 80 amino acid residues, such as less than 75 amino acid residues, for example less than 70 amino acid residues, such as less than 65 amino acid residues, for example less than 60 amino acid residues, such as less than 55 amino acid residues, for example less than 50 amino acid residues, such as less than 45 amino acid residues, for example less than 40 amino acid residues, such as less than 35 amino acid residues, for example less than 30 amino acid residues, such as less than 25 amino acid residues, for example less than 20 amino acid residues, such as less than 15 amino acid residues, for example less than 12 amino acid residues, such as less than 10 amino acid residues, for example less than 8 amino acid residues, such as less than 7 amino acid residues, for example less than 6 amino acid residues, such as less than 5 amino acid residues, for example less than 4 amino acid residues, such as less than 3 amino acid residues.

"Functional equivalency" as used in the present invention is according to one preferred embodiment established by means of reference to the corresponding functionality of a predetermined fragment of the sequence.

Functional equivalents or variants of a glycosylated mucin peptide will be understood to exhibit amino acid sequences gradually differing from the preferred predetermined sequence, as the number and scope of insertions, deletions and substitutions including conservative substitutions increases. This difference is measured as a reduction in homology between the preferred predetermined sequence and the fragment or functional equivalent.

All fragments or functional equivalents of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO: 29 and SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68 and SEQ ID NO:69 are included within the scope of this invention, regardless of the degree of homology that they show to the respective, predetermined peptide sequences disclosed herein. The reason for this is that some regions of the peptide are most likely readily mutatable, or capable of being completely deleted, without any significant effect on the binding activity of the resulting fragment.

The homology between amino acid sequences may be calculated using well known scoring matrices such as any one of BLOSUM 30, BLOSUM 40, BLOSUM 45, BLOSUM 50, BLOSUM 55, BLOSUM 60, BLOSUM 62, BLOSUM 65, BLOSUM 70, BLOSUM 75, BLOSUM 80, BLOSUM 85, and BLOSUM 90.

Fragments sharing homology with fragments of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO: 29 and SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68 and SEQ ID NO:69, respectively, are to be considered as falling within the scope of the present invention when they are preferably at least about 90 percent homologous, for example at least 92 percent homologous, such as at least 94 percent homologous, for example at least 95 percent homologous, such as at least 96 percent homologous, for example at least 97 percent homologous, such as at least 98 percent homologous, for example at least 99 percent homologous with said predetermined fragment sequences, respectively. According to one embodiment of the invention the homology percentages refer to identity percentages.

Additional factors that may be taken into consideration when determining functional equivalence according to the meaning used herein are i) the ability of antisera to detect a peptide fragment according to the present invention, or ii) the ability of the functionally equivalent peptide fragment to compete with the corresponding peptide in an assay, such as an inhibition assay. One method of determining a sequence of immunogenically active amino acids within a known amino acid sequence has been described by Geysen in U.S. Pat. No. 5,595,915 and is incorporated herein by reference.

A further suitably adaptable method for determining structure and function relationships of peptide fragments is described by U.S. Pat. No. 6,013,478, which is herein incorporated by reference. Also, methods of assaying the binding of an amino acid sequence to a receptor moiety are known to the skilled artisan.

In addition to conservative substitutions introduced into any position of a preferred predetermined sequence, or a fragment thereof, it may also be desirable to introduce non-conservative substitutions in any one or more positions of the glycopeptides of the invention.

A non-conservative substitution leading to the formation of a functionally equivalent peptide fragment would for example i) differ substantially in polarity, for example a residue with a non-polar side chain (Ala, Leu, Pro, Trp, Val, Ile, Leu, Phe or Met) substituted for a residue with a polar side chain such as Gly, Ser, Thr, Cys, Tyr, Asn, or Gln or a charged amino acid such as Asp, Glu, Arg, or Lys, or substituting a charged or a polar residue for a non-polar one; and/or ii) differ substantially in its effect on polypeptide backbone orientation such as substitution of or for Pro or Gly by another residue; and/or iii) differ substantially in electric charge, for example substitution of a negatively charged residue such as Glu or Asp for a positively charged residue such as Lys, His or Arg (and vice versa); and/or iv) differ substantially in steric bulk, for example substitution of a bulky residue such as His, Trp, Phe or Tyr for one having a minor side chain, e.g. Ala, Gly or Ser (and vice versa).

Variants obtained by substitution of amino acids may in one preferred embodiment be made based upon the hydrophobicity and hydrophilicity values and the relative similarity of the amino acid side-chain substituents, including charge, size, and the like. Exemplary amino acid substitutions which take various of the foregoing characteristics into consideration are well known to those of skill in the art and include: arginine and lysine; glutamate and aspartate; serine and threonine; glutamine and asparagine; and valine, leucine and isoleucine.

In addition to the variants described herein, sterically similar variants may be formulated to mimic the key portions of the variant structure and that such compounds may also be used in the same manner as the variants of the invention. This may be achieved by techniques of modelling and chemical designing known to those of skill in the art. It will be understood that all such sterically similar constructs fall within the scope of the present invention.

In a further embodiment the present invention relates to functional variants comprising substituted amino acids having hydrophilic values or hydropathic indices that are within +/−4.9, for example within +/−4.7, such as within +/−4.5, for example within +/−4.3, such as within +/−4.1, for example within +/−3.9, such as within +/−3.7, for example within +/−3.5, such as within +/−3.3, for example within +/−3.1, such as within +/−2.9, for example within +/−2.7, such as within +/−2.5, for example within +/−2.3, such as within +/−2.1, for example within +/−2.0, such as within +/−1.8, for example within +/−1.6, such as within +/−1.5, for example within +/−1.4, such as within +/−1.3 for example within +/−1.2, such as within +/−1.1, for example within +/−1.0, such as within +/−0.9, for example within +/−0.8, such as within +/−0.7, for example within +/−0.6, such as within +/−0.5, for example within +/−0.4, such as within +/−0.3, for example within +/−0.25, such as within +/−0.2 of the value of the amino acid it has substituted.

The importance of the hydrophilic and hydropathic amino acid indices in conferring interactive biologic function on a protein is well understood in the art (Kyte & Doolittle, 1982 and Hopp, U.S. Pat. No. 4,554,101, each incorporated herein by reference).

The amino acid hydropathic index values as used herein are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5) (Kyte & Doolittle, 1982).

The amino acid hydrophilicity values are: arginine (+3.0); lysine (+3.0); aspartate (+3.0.+−0.1); glutamate (+3.0.+−0.1); serine (+0.3); asparagine (+0.2); glutamine (+0.2); glycine (0); threonine (−0.4); proline (−0.5.+−0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4) (U.S. Pat. No. 4,554,101).

In addition to the peptidyl compounds described herein, sterically similar compounds may be formulated to mimic the key portions of the peptide structure and that such compounds may also be used in the same manner as the peptides of the invention. This may be achieved by techniques of modelling and chemical designing known to those of skill in the art. For example, esterification and other alkylations may be employed to modify the amino terminus of, e.g., a di-arginine peptide backbone, to mimic a tetra peptide structure. It will be understood that all such sterically similar constructs fall within the scope of the present invention.

Peptides with N-terminal alkylations and C-terminal esterifications are also encompassed within the present invention. Functional equivalents also comprise glycosylated and covalent or aggregative conjugates formed with the same or other peptide fragments, including dimers or unrelated chemical moieties. Such functional equivalents are prepared by linkage of functionalities to groups which are found in fragment including at any one or both of the N- and C-termini, by means known in the art.

Functional equivalents may thus comprise fragments conjugated to aliphatic or acyl esters or amides of the carboxyl terminus, alkylamines or residues containing carboxyl side chains, e.g., conjugates to alkylamines at aspartic acid residues; O-acyl derivatives of hydroxyl group-containing residues and N-acyl derivatives of the amino terminal amino acid or amino-group containing residues, e.g. conjugates with fMet-Leu-Phe or immunogenic proteins. Derivatives of the acyl groups are selected from the group of alkyl-moieties (including C3 to 010 normal alkyl), thereby forming alkanoyl species, and carbocyclic or heterocyclic compounds, thereby forming aroyl species. The reactive groups preferably are difunctional compounds known per se for use in cross-linking proteins to insoluble matrices through reactive side groups.

Covalent or aggregative functional equivalents and derivatives thereof are useful as reagents in immunoassays or for affinity purification procedures. For example, a fragment of a mucin of the invention may be made insoluble by covalent bonding to cyanogen bromide-activated Sepharose by methods known per se or adsorbed to polyolefin surfaces, either with or without glutaraldehyde cross-linking, for use in an assay or purification of anti-mucin antibodies or cell surface receptors. Fragments may also be labelled with a detectable group, e.g., radioiodinated by the chloramine T procedure, covalently bound to rare earth chelates or conjugated to another fluorescent moiety for use in e.g. diagnostic assays.

Mutagenesis of a preferred predetermined fragment of a mucin epitope of the invention can be conducted by making amino acid insertions, usually on the order of about from 1 to 10 amino acid residues, preferably from about 1 to 5 amino acid residues, or deletions of from about from 1 to 10 residues, such as from about 2 to 5 residues.

In one embodiment the fragment of the mucin epitope is synthesised by automated synthesis. Any of the commercially available solid-phase techniques may be employed, such as the Merrifield solid phase synthesis method, in which amino acids are sequentially added to a growing amino acid chain. (See Merrifield, J. Am. Chem. Soc. 85:2149-2146, 1963).

Equipment for automated synthesis of polypeptides is commercially available from suppliers such as Applied Biosystems, Inc. of Foster City, Calif., and may generally be operated according to the manufacturer's instructions. Solid phase synthesis will enable the incorporation of desirable amino acid substitutions into any fragment according to the present invention. It will be understood that substitutions, deletions, insertions or any subcombination thereof may be combined to arrive at a final sequence of a functional equivalent. Insertions shall be understood to include amino-terminal and/or carboxyl-terminal fusions, e.g. with a hydrophobic or immunogenic protein or a carrier such as any polypeptide or scaffold structure capable as serving as a carrier.

Oligomers including dimers including homodimers and heterodimers of fragments of mucin glycopeptides according to the invention are also provided and fall under the scope of the invention. Mucin peptide equivalents and variants can be produced as homodimers or heterodimers with other amino acid sequences or with native mucin sequences. Heterodimers include dimers containing immunoreactive mucin fragments as well as mucin fragments that need not have or exert any biological activity.

Mucin glycopeptide fragments according to the invention may be synthesised both in vitro and in vivo. Method for in vitro synthesis are well known, and methods being suitable or suitably adaptable to the synthesis in vivo are also described in the prior art. The GalNAc moiety of the glycans of the invention can be included in the peptide synthesis by the inclusion of GalNAc-S/T building blocks. When synthesized in vivo, a host cell is transformed with vectors containing DNA encoding mucin fragments or a fragment thereof. A vector is defined as a replicable nucleic acid construct. Vectors are used to mediate expression of mucin fragments. An expression vector is a replicable DNA construct in which a nucleic acid sequence encoding the predetermined mucin fragment, or any functional equivalent thereof that can be expressed in vivo, is operably linked to suitable control sequences capable of effecting the expression of the fragment or equivalent in a suitable host. Such control sequences are well known in the art.

Cultures of cells derived from multicellular organisms represent preferred host cells. In principle, any higher eukaryotic cell culture is workable, whether from vertebrate or invertebrate culture. Examples of useful host cell lines are VERO and HeLa cells, Chinese hamster ovary (CHO) cell lines, and W138, BHK, COS-7, 293 and MDCK cell lines. Preferred host cells are eukaryotic cells known to synthesize endogenous mucins. Cultures of such host cells may be isolated and used as a source of the fragment, or used in therapeutic methods of treatment, including therapeutic methods aimed at promoting or inhibiting a growth state, or diagnostic methods carried out on the human or animal body.

Glycosylation

Glycosylation is the enzymatic process that links saccharides to produce glycans, attached to proteins, lipids, or other organic molecules. This enzymatic process produces one of the fundamental biopolymers found in cells (along with DNA, RNA, and proteins). Glycosylation is a form of co-translational and post-translational modification. Glycans serve a variety of structural and functional roles in membrane and secreted proteins. The majority of proteins synthesised in the rough ER undergo glycosylation. It is an enzyme-directed site-specific process, as opposed to the non-enzymatic chemical reaction of glycation. Glycosylation also occurs in the cytoplasm and nucleus, for example the O-GlcNAc modification. Five classes of glycan modification of peptides can be produced: N-linked glycans attached to a nitrogen of asparagine or arginine side chains, O-linked glycans attached to the hydroxy oxygen of serine, threonine, tyrosine, hydroxylysine, or hydroxyproline side chains, or to oxygens on lipids such as ceramide; phosphoglycans linked through the phosphate of a phospho-serine; C-linked glycans, a rare form of glycosylation where a sugar is added to a carbon on a tryptophan side chain, and glypiation which is the addition of a GPI anchor which links proteins to lipids through glycan linkages. The glycosylation of main interest in the present invention is O-linked glycosylation. This type of glycosylation occurs at a late stage during protein processing, in the Golgi apparatus. This is the addition of N-acetyl-galactosamine to serine or threonine residues by the enzyme UDP-N-acetyl-D-galactosamine: polypeptide N-acetylgalactosam inyltransferase (EC 2.4.1.41), followed by other carbohydrates (such as galactose and sialic acid). This process is important for certain types of proteins such as proteoglycans, which involves the addition of glycosaminoglycan chains to an initially unglycosylated "proteoglycan core protein." These additions are usually serine O-linked glycoproteins, which seem to have one of two main functions. One function involves secretion to form components of the extracellular matrix, adhering one cell to another by interactions between the large sugar complexes of proteoglycans. The other main function is to act as a component of mucosal secretions, and it is the high concentration of carbohydrates that tends to give mucus its consistency. In addition, O-linked glycans are involved in directing cleavage of membrane proteins, intracellular sorting, secretion, protease resistance and in intracellular signalling.

In one embodiment of the present invention, at least one amino acid residue, such as at least two amino acid residues, for example at least three amino acid residues, such as at least at least four amino acid residues, for example at least five amino acid residues of the mucin peptides defined herein above is/are glycosylated by an O-linked glycan selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

Each Serine (S) or Threonine (T) residue of the polypeptides selected from the group consisting of PMTDTKT-VTTPGSSFTA (SEQ ID NO: 3), PGSSFTASGHSP-SEIVPQD (SEQ ID NO: 4), SEIVPQDAPTISAATTFAPA (SEQ ID NO: 5), TTFAPAPTGNGHTTQAPTTA (SEQ ID NO: 6), TTQAPTTALQAAPSSHD (SEQ ID NO: 7), APSSHDATLGPSGGTSLSKT (SEQ ID NO: 8), SLSKT-GALTLANSVVSTP (SEQ ID NO: 9), NSVVSTPGG-PEGQWTSASAS (SEQ ID NO: 10), TSASAST-SPRTAAAMTHT (SEQ ID NO: 11), AAAMTHTHQAESTEASGQT (SEQ ID NO: 12), EAS-GQTQTSEPASSGSRTT (SEQ ID NO: 13), PASSGSRTT-SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), PVTYASSASTGDTTPLPVTDTSSVSTGHAT (SEQ ID NO: 22), STGDTLPLPVTDTSSV (SEQ ID NO: 23), VTSAPDTRPAPGSTAPPAHG (SEQ ID NO: 24), PTTTPITTTTTVTPTPTPTGTQTPTTTPISTTC (SEQ ID NO:25) and PMTDTKTVTTPGSSFTASGHSP-SEIVPQDAPTISAATZFAPAPTGNGHTTQAPTTALQ AAPSSHDATLGPSGGTSLSKTGALTLANSVVSTPGG-PEGQWTSASASTSPDTAAAMT HTHQAESTEAS-GQTQTSEPASSGSRTTSAGTATPSSSGAS-GTTPSGSEGISTSGETT RFSSNPSRDSHTT (SEQ ID NO: 30) may be individually and optionally glycosylated by one of the glycans selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

Thus, in one embodiment of the present invention, one or more amino acid residues of the mucin peptide is/are Core-3 (GlcNAcβ1-3GalNAc-α-Ser/Thr) glycosylated.

In another embodiment of the present invention, one or more amino acid residues of the mucin peptide is/are Tn (GalNAc-α-Ser/Thr) glycosylated.

In another embodiment of the present invention, one or more amino acid residues of the mucin peptide is/are STn/sialyl-Tn (Neu5Acα2-6GalNAc-α-Ser/Thr) glycosylated.

In another embodiment of the present invention, one or more amino acid residues of the mucin peptide is/are Core-2 ((Galβ1-3(GlcNAcβ1-6)GalNAc-α-Ser/Thr)) glycosylated.

In yet another embodiment of the present invention, one or more amino acid residues of the mucin peptide is/are Core-4 (GlcNAcβ1-3(GlcNAcβ1-6)GalNAc-α-Ser/Thr) glycosylated.

In yet another embodiment of the present invention, one or more amino acid residues of the mucin peptide is/are ST/sialyl-T (Neu5Acα2-3Galβ3GalNAc-Ser/Thr) glycosylated.

In one embodiment, the peptide used in the methods for detecting cancer defined herein above, is selected from the group consisting of:
VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3) RPAPGS(Core3)T(Core3)APPAHG (MUC1 15Core3), VT(STn)S(STn)APDT(STn)RPAPGS(STn)T(STn) APPAHG (MUC 1 (15STn), VT(STn)SAPDTRPAPGS (STn)T(STn)APPAHG (MUC1 9STn), VT(Tn)S(Tn)APDT (Tn)RPAPGS(Tn)T(Tn)APPAHG (MUC1 15Tn), VT(Tn) SAPDTRPAPGS(Tn)T(Tn)APPAHG (MUC1 9Tn), VT(Tn) SAPDTRPAPGST(Tn)APPAHG (MUC1 6Tn) and PVT (Tn)YAS(Tn)S(Tn)AS(Tn)T(Tn)GDT(Tn)T(Tn)PLPVT (Tn)DT(Tn)S(Tn)S(Tn)VS(Tn) T(Tn)GHAT(Tn).

In one embodiment a glycopeptide selected from the group consisting of VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3) RPAPGS(Core3)T(Core3)APPAHG (MUC1-15Core3), VT(STn)S(STn)APDT(STn)RPAPGS(STn)T(STn) APPAHG (MUC 1 (15STn), VT(STn)SAPDTRPAPGS (STn)T(STn)APPAHG (MUC1 9STn), VT(Tn)S(Tn)APDT (Tn)RPAPGS(Tn)T(Tn)APPAHG (MUC1 15Tn), VT(Tn) SAPDTRPAPGS(Tn)T(Tn)APPAHG (MUC1 9Tn), VT(Tn) SAPDTRPAPGST(Tn)APPAHG (MUC1 6Tn) and PVT (Tn)YAS(Tn)S(Tn)AS(Tn)T(Tn)GDT(Tn)T(Tn)PLPVT (Tn)DT(Tn)S(Tn)S(Tn)VS(Tn) T(Tn)GHAT(Tn) is used in a method of detecting IgG autoantibodies in a sample from a subject, wherein the presence of said autoantibodies to any of said glycopeptides indicates colorectal cancer.

In one embodiment, the peptide of the present invention is selected from the group consisting of: VTSAPDT(Core3) RPAPGSTAPPAHG, VT(Core3)SAPDTRPAPGS(Core3)T (Core3)APPAHG, VT(Core3)S(Core3)APDT(Core3) RPAPGS(Core3)T(Core3)APPAHG, VT(STn)S(STn) APDT(STn)RPAPGS(STn)T(STn)APPAHG, VT(STn) SAPDTRPAPGS(STn)T(STn)APPAHG, VT(Tn)S(Tn) APDT(Tn)RPAPGS(Tn)T(Tn)APPAHG, VT(Tn) SAPDTRPAPGS(Tn)T(Tn)APPAHG, VT(Tn) SAPDTRPAPGST(Tn)APPAHG (MUC1 6Tn) and PVT (Tn)YAS(Tn)S(Tn)AS(Tn)T(Tn)GDT(Tn)T(Tn)PLPVT (Tn)DT(Tn)S(Tn)S(Tn)VS(Tn) T(Tn)GHAT(Tn), wherein Core-3 is GlcNAcβ1-3GalNAc-α-Ser/Thr, and wherein Tn is GalNAc-α-Ser/Thr, and wherein STn/sialyl-Tn is Neu5Acα2-6GalNAc-α-Ser/Thr, and wherein Core-2 is Galβ1-3(GlcNAcβ1-6)GalNAc-α-Ser/Thr and wherein Core-4 is GlcNAcβ1-3(GlcNAcβ1-6)GalNAc-α-Ser/Thr, and wherein the glycosylation is on the serine (S) or Threonine (T) amino acid residue preceding the glycan denotation.

In one embodiment a glycopeptide selected from the group consisting of VTSAPDT(Core3)RPAPGSTAPPAHG, VT(Core3)SAPDTRPAPGS(Core3)T(Core3)APPAHG, VT(Core3)S (Core3)APDT(Core3)RPAPGS(Core3)T(Core3)APPAHG, VT(STn)S(STn)APDT(STn)RPAPGS(STn)T(STn) APPAHG, VT(STn)SAPDTRPAPGS(STn)T(STn) APPAHG, VT(Tn)S(Tn)APDT(Tn)RPAPGS(Tn)T(Tn) APPAHG, VT(Tn)SAPDTRPAPGS(Tn)T(Tn)APPAHG, VT(Tn)SAPDTRPAPGST(Tn)APPAHG (MUC1 6Tn) and PVT(Tn)YAS(Tn)S(Tn)AS(Tn)T(Tn)GDT(Tn)T(Tn) PLPVT(Tn)DT(Tn)S(Tn)S(Tn)VS(Tn) T(Tn)GHAT(Tn), is used in a method of detecting IgA autoantibodies in a sample from a subject, wherein the presence of said autoantibodies to any of said glycopeptides indicates colorectal cancer.

Core-3 is an abbreviation for GlcNAcβ1-3GalNAc-α-Ser/Thr, and Tn is an abbreviation for GalNAc-α-Ser/Thr. STn or sialyl-Tn is an abbreviation for Neu5Acα2-6GalNAc-α-Ser/Thr. Core-2 is an abbreviation for Galβ1-3(GlcNAcβ1-6)GalNAc-α-Ser/Thr. Core-4 is an abbreviation for GlcNAcβ1-3(GlcNAcβ1-6)GalNAc-α-Ser/Thr. Glycosylation occurs on the serine (S) or Threonine (T) amino acid residue preceding the glycan denotation as defined herein above.

In one embodiment, the peptide of the invention is selected from the group consisting of PVT*YAS*S*AS*T*GDT*T*PLPVT*DT*S*S*VS*T* GHAT* (MUC4-TR Tn) and PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (MUC4 Tn), wherein the asterisk (*) indicates a potential O-glycosylation site. Accordingly, each asterisk signifies that the amino acid residue preceding said asterisk can be glycosylated by an O-linked glycan selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

Antibodies

Other aspects of the present invention are antibodies prepared using the glycopeptides defined herein above, methods for preparation of said antibodies and use of said antibodies in therapy and diagnosis. Also part of the invention are antibodies capable of recognising the IO-glycosylated peptides of the present invention, wherein said antibodies are produced by state-of-the art recombinant methods.

An antibody binds tightly to a particular target molecule, thereby either inactivating it directly or marking it for destruction. The antibody recognizes its target (antigen) with remarkable specificity and strength dictated by the sum of many chemical forces, including hydrogen bonds, hydrophobic and van der Waal's forces, as well as ionic interactions. In general, the more complex the target is chemically, the more immunogenic it will be. The antigenic determinant may encompass short linear amino acid stretches or a more complicated, three-dimensional protein module.

Conceptually, antibodies directed against a target receptor may inhibit ligand binding in two ways: competitive or allosteric. Competitive inhibition involves the direct binding of the antibody to or near the ligand binding site on the receptor, thereby displacing the ligand from its receptor or sterically inhibiting the approach of the ligand to the ligand binding site. Allosteric inhibition involves the binding of the antibody to a site on the receptor polypeptide that is distinct from the ligand binding epitope. However, binding to this site will induce a conformational change in the overall structure of the receptor that makes it more difficult or even impossible for the ligand to bind to its cognate recognition site.

The antibody or functional equivalent thereof may be any antibody known in the art, for example a polyclonal or a monoclonal antibody derived from a mammal or a synthetic antibody, such as a single chain antibody or hybrids comprising antibody fragments. Furthermore, the antibody may be mixtures of monoclonal antibodies or artificial polyclonal antibodies. In addition functional equivalents of antibodies may be antibody fragments, in particular epitope binding fragments. Furthermore, antibodies or functional equivalent thereof may be a small molecule mimicking an antibody. Naturally occurring antibodies are immunoglobulin molecules consisting of heavy and light chains. In preferred embodiments of the invention, the antibody is a monoclonal antibody.

Monoclonal antibodies (Mab's) are antibodies, wherein every antibody molecule are similar and thus recognises the same epitope. Monoclonal antibodies are in general produced by a hybridoma cell line. Methods of making monoclonal antibodies and antibody-synthesizing hybridoma cells are well known to those skilled in the art. Antibody producing hybridomas may for example be prepared by fusion of an antibody producing B lymphocyte with an immortalized B-lymphocyte cell line. Monoclonal antibodies according to the present invention may for example be prepared as described in Antibodies: A Laboratory Manual, By Ed Harlow and David Lane, *Cold Spring Harbor Laboratory Press*, 1988. Said monoclonal antibodies may be derived from any suitable mammalian species, however frequently the monoclonal antibodies will be rodent antibodies for example murine or rat monoclonal antibodies. It is preferred that the antibodies according to the present invention are monoclonal antibodies or derived from monoclonal antibodies.

Polyclonal antibodies is a mixture of antibody molecules recognising a specific given antigen, hence polyclonal antibodies may recognise different epitopes within said antigen. In general polyclonal antibodies are purified from serum of a mammal, which previously has been immunized with the antigen. Polyclonal antibodies may for example be prepared by any of the methods described in Antibodies: A Laboratory Manual, By Ed Harlow and David Lane, *Cold Spring Harbor Laboratory Press*, 1988. Polyclonal antibodies may be derived from any suitable mammalian species, for example from mice, rats, rabbits, donkeys, goats, sheeps, cows or camels. The antibody is preferably not derived from a non-mammalian species, i.e. the antibody is for example preferably not a chicken antibody. The antibody may also for example be an artificial polyclonal antibody as for example described in U.S. Pat. No. 5,789,208 or U.S. Pat. No. 6,335,163, both patent specifications are hereby incorporated by reference into the application in their entirety.

The antibodies according to the present invention may also be recombinant antibodies. Recombinant antibodies are antibodies or fragments thereof or functional equivalents thereof produced using recombinant technology. For example recombinant antibodies may be produced using a synthetic library or by phage display. Recombinant antibodies may be produced according to any conventional method for example the methods outlined in "Recombinant Antibodies", Frank Breitling, Stefan Dübel, Jossey-Bass, September 1999.

The antibodies according to the present invention may also be bispecific antibodies, i.e. antibodies specifically recognising two different epitopes. Bispecific antibodies may in general be prepared starting from monoclonal antibodies, or from recombinant antibodies, for example by fusing two hybridoma's in order to combine their specificity, by Chemical crosslinking or using recombinant technologies. Antibodies according to the present invention may also be tri-specific antibodies.

Functional equivalents of antibodies may in one preferred embodiment be a fragment of an antibody, preferably an antigen binding fragment or a variable region. Examples of antibody fragments useful with the present invention include Fab, Fab', F(ab')$_2$ and Fv fragments. Papain digestion of antibodies produces two identical antigen binding fragments, called the Fab fragment, each with a single antigen binding site, and a residual "Fc" fragment, so-called for its ability to crystallize readily. Pepsin treatment yields an F(ab')$_2$ fragment that has two antigen binding fragments which are capable of cross-linking antigen, and a residual other fragment (which is termed pFc'). Additional fragments can include diabodies, linear antibodies, single-chain antibody molecules, and multispecific antibodies formed from antibody fragments. As used herein, "functional fragment" with respect to antibodies, refers to Fv, F(ab) and F(ab')$_2$ fragments.

Preferred antibody fragments retain some or essential all the ability of an antibody to selectively binding with its antigen or receptor. Some preferred fragments are defined as follows:
(1) Fab is the fragment that contains a monovalent antigen-binding fragment of an antibody molecule. A Fab fragment can be produced by digestion of whole antibody with the enzyme papain to yield an intact light chain and a portion of one heavy chain.
(2) Fab' is the fragment of an antibody molecule and can be obtained by treating whole antibody with pepsin, followed by reduction, to yield an intact light chain and a portion of the heavy chain. Two Fab' fragments are obtained per antibody molecule. Fab' fragments differ from Fab fragments by the addition of a few residues at the carboxyl terminus of the heavy chain CH1 domain including one or more cysteines from the antibody hinge region.
(3) (Fab')$_2$ is the fragment of an antibody that can be obtained by treating whole antibody with the enzyme pepsin without subsequent reduction. F(ab')$_2$ is a dimer of two Fab' fragments held together by two disulfide bonds.
(4) Fv is the minimum antibody fragment that contains a complete antigen recognition and binding site. This region consists of a dimer of one heavy and one light chain variable domain in a tight, non-covalent association ($V_H$-$V_L$ dimer). It is in this configuration that the three CDRs of each variable domain interact to define an antigen binding site on the surface of the $V_H$-$V_L$ dimer. Collectively, the six CDRs confer antigen binding specificity to the antibody. However, even a single variable domain (or half of an Fv comprising only three CDRs specific for an antigen) has the ability to recognize and bind antigen, although at a lower affinity than the entire binding site.

In one embodiment of the present invention the antibody is a single chain antibody ("SCA"), defined as a genetically engineered molecule containing the variable region of the light chain, the variable region of the heavy chain, linked by a suitable polypeptide linker as a genetically fused single chain molecule. Such single chain antibodies are also referred to as "single-chain Fv" or "scFv" antibody fragments. Generally, the Fv polypeptide further comprises a polypeptide linker between the VH and VL domains that enables the scFv to form the desired structure for antigen binding.

In another embodiment of the present invention the functional equivalent of an antibody is a small molecule mimicking an antibody. Such molecules may be a non-immunoglobulin binding members. Thus the epitope polypeptide of the present invention binding may be derived from a naturally occurring protein or polypeptide; said protein or polypeptide may for example be designed de novo, or may be selected from a library. The binding member may be a single moiety, e.g., a polypeptide or protein domain, or it may include two or more moieties, e.g., a pair of polypeptides such as a pair polypeptides. The binding polypeptide may for example, but not exclusively, be a lipocalin, a single chain MHC molecule, an Anticalin™ (Pieris), an Affibody™, or a Trinectin™ (Phylos), Nanobodies (Ablynx). The binding member may be selected or designed by recombinant methods known by people well known in the art.

Human monoclonal antibodies of the invention can be produced by a variety of techniques, including conventional monoclonal antibody methodology, e.g., the standard somatic cell hybridization technique of Kohler and Milstein, *Nature* 256:495 (1975). Although somatic cell hybridization procedures are preferred, in principle, other techniques for producing monoclonal antibody can be employed, e.g., viral or oncogenic transformation of B-lymphocytes or phage display techniques using libraries of human antibody genes.

Immunizations

To generate fully human monoclonal antibodies to the epitopes of interest to the present invention, transgenic or transchromosomal mice containing human immunoglobulin genes can be immunized with an enriched preparation of the antigen and/or cells expressing the epitopes of the receptor targets of the present invention, as described, for example, by Lonberg et al. (1994), supra; Fishwild et al. (1996), supra, and WO 98/24884. Alternatively, mice can be immunized with DNA encoding the CaOU-1 epitope. Preferably, the mice will be 6-16 weeks of age upon the first infusion.

Cumulative experience with various antigens has shown that the HuMAb transgenic mice respond best when initially immunized intraperitoneally (i.p.) or subcutaneously (s.c.) with antigen expressing cells in complete Freund's adjuvant, followed by every other week i.p. immunizations (up to a total of 10) with the antigen expressing cells in PBS. The immune response can be monitored over the course of the immunization protocol with plasma samples being obtained by retroorbital bleeds. The plasma can be screened by FACS analysis, and mice with sufficient titers of anti-antigen human immunoglobulin can be used for fusions. Mice can be boosted intravenously with antigen expressing cells for example 4 and 3 days before sacrifice and removal of the spleen.

Use of Partial Antibody Sequences to Express Intact Antibodies

Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific naturally occurring antibodies by constructing expression vectors that include CDR sequences from the specific naturally occurring antibody grafted onto framework sequences from a different antibody with different properties (see, e.g., Riechmann, L. et al. (1998) Nature 332:323-327; Jones, P. et al. (1986) Nature 321:522-525; and Queen, C. et al. (1989) Proc. Natl. Acad. Sci. USA 86:10029-10033). Such framework sequences can be obtained from public DNA databases that include germline antibody gene sequences. These germline sequences will differ from mature antibody gene sequences because they will not include completely assembled variable genes, which are formed by V(D)J joining during B cell maturation. Germline gene sequences will also differ from the sequences of a high affinity secondary repertoire antibody which contains mutations throughout the variable gene but typically clustered in the CDRs. For example, somatic mutations are relatively infrequent in the amino terminal portion of framework region 1 and in the carboxy-terminal portion of framework region 4. For this reason, it is not necessary to obtain the entire DNA sequence of a particular antibody in order to recreate an intact recombinant antibody having binding properties similar to those of the original antibody (see WO 99/45962). Partial heavy and light chain sequence spanning the CDR regions is typically sufficient for this purpose. The partial sequence is used to determine which germline variable and joining gene segments contributed to the recombined antibody variable genes. The germline sequence is then used to fill in missing portions of the variable regions. Heavy and light chain leader sequences are cleaved during protein maturation and do not contribute to the properties of the final antibody. To add missing sequences, cloned cDNA sequences can be combined with synthetic oligonucleotides by ligation or PCR amplification. Alternatively, the entire variable region can be synthesized as a set of short, overlapping, oligonucleotides and combined by PCR amplification to create an entirely synthetic variable region clone. This process has certain advantages such as elimination or inclusion or particular restriction sites, or optimization of particular codons.

The nucleotide sequences of heavy and light chain transcripts from hybridomas are used to design an overlapping set of synthetic oligonucleotides to create synthetic V sequences with identical amino acid coding capacities as the natural sequences. The synthetic heavy and kappa chain sequences can differ from the natural sequences in three ways: strings of repeated nucleotide bases are interrupted to facilitate oligonucleotide synthesis and PCR amplification; optimal translation initiation sites are incorporated according to Kozak's rules (Kozak, 1991, J. Biol. Chem. 266: 19867-19870); and HindIII sites are engineered upstream of the translation initiation sites.

For both the heavy and light chain variable regions, the optimized coding and corresponding non-coding, strand sequences are broken down into 30-50 nucleotides approximately at the midpoint of the corresponding non-coding oligonucleotide. Thus, for each chain, the oligonucleotides can be assembled into overlapping double stranded sets that span segments of 150-400 nucleotides. The pools are then used as templates to produce PCR amplification products of 150-400 nucleotides. Typically, a single variable region oligonucleotide set will be broken down into two pools which are separately amplified to generate two overlapping PCR products. These overlapping products are then combined by PCR amplification to form the complete variable region. It may also be desirable to include an overlapping fragment of the heavy or light chain constant region (including the Bbsl site of the kappa light chain, or the AgeI site of the gamma heavy chain) in the PCR amplification to generate fragments that can easily be cloned into the expression vector constructs.

The reconstructed heavy and light chain variable regions are then combined with cloned promoter, leader, translation initiation, constant region, 3' untranslated, polyadenylation, and transcription termination, sequences to form expression vector constructs. The heavy and light chain expression constructs can be combined into a single vector, co-transfected, serially transfected, or separately transfected into host cells which are then fused to form a host cell expressing both chains.

Monovalent Antibodies

The monospecific binding polypeptide may be monovalent, i.e. having only one binding domain.

For a monovalent antibody, the immunoglobulin constant domain amino acid residue sequences comprise the structural portions of an antibody molecule known in the art as CH1, CH2, CH3 and CH4. Preferred are those binding polypeptides which are known in the art as $C_L$. Preferred $C_L$ polypeptides are selected from the group consisting of $C_{kappa}$ and $C_{lambda}$.

Furthermore, insofar as the constant domain can be either a heavy or light chain constant domain ($C_H$ or $C_L$, respectively), a variety of monovalent binding polypeptide compositions are contemplated by the present invention. For example, light chain constant domains are capable of disulfide bridging to either another light chain constant domain, or to a heavy chain constant domain. In contrast, a heavy chain constant domain can form two independent disulfide bridges, allowing for the possibility of bridging to both another heavy chain and to a light chain, or to form polymers of heavy chains.

Thus, in another embodiment, the invention contemplates an isolated monovalent binding polypeptide wherein the constant chain domain C has a cysteine residue capable of forming at least one disulfide bridge, and where at least two monovalent polypeptides are covalently linked by said disulfide bridge.

In preferred embodiments, the constant chain domain C can be either $C_L$ or $C_H$. Where C is $C_L$, the $C_L$ polypeptide is preferably selected from the group consisting of $C_{kappa}$ and $C_{lambda}$.

In another embodiment, the invention contemplates a binding polypeptide composition comprising a monovalent polypeptide as above except where C is $C_L$ having a cysteine residue capable of forming a disulfide bridge, such that the composition contains two monovalent polypeptides covalently linked by said disulfide bridge.

Multispecificity, Including Bispecificity

In a preferred embodiment the present invention relates to multispecific binding polypeptides, which have affinity for and are capable of binding at least two different entities. Multispecific binding polypeptides can include bispecific binding polypeptides.

In one embodiment the multispecific molecule is a bispecific antibody (BsAb), which carries at least two different binding domains, where preferably at least one of which is of antibody origin.

A bispecific molecule of the invention can also be a single chain bispecific molecule, such as a single chain bispecific antibody, a single chain bispecific molecule comprising one single chain antibody and a binding domain, or a single chain bispecific molecule comprising two binding domains. Multispecific molecules can also be single chain molecules or may comprise at least two single chain molecules.

The multispecific, including bispecific, antibodies may be produced by any suitable manner known to the person skilled in the art.

The traditional approach to generate bispecific whole antibodies was to fuse two hybridoma cell lines each producing an antibody having the desired specificity. Because of the random association of immunoglobulin heavy and light chains, these hybrid hybridomas produce a mixture of up to 10 different heavy and light chain combinations, only one of which is the bispecific antibody. Therefore, these bispecific antibodies have to be purified with cumbersome procedures, which considerably decrease the yield of the desired product.

Alternative approaches include in vitro linking of two antigen specificities by chemical cross-linking of cysteine residues either in the hinge or via a genetically introduced C-terminal Cys as described above. An improvement of such in vitro assembly was achieved by using recombinant fusions of Fab' s with peptides that promote formation of heterodimers. However, the yield of bispecific product in these methods is far less than 100%.

A more efficient approach to produce bivalent or bispecific antibody fragments, not involving in vitro chemical assembly steps, was described by Holliger et al. (1993). This approach takes advantage of the observation that scFv's secreted from bacteria are often present as both monomers and dimers. This observation suggested that the $V_H$ and $V_L$ of different chains could pair, thus forming dimers and larger complexes. The dimeric antibody fragments, also named "diabodies" by Hollinger et al., are in fact small bivalent antibody fragments that assembled in vivo. By linking the $V_H$ and $V_L$ of two different antibodies 1 and 2, to form "cross-over" chains $V_H 1V_L 2$ and $V_H 2-V_L 1$, the dimerisation process was shown to reassemble both antigen-binding sites. The affinity of the two binding sites was shown to be equal to the starting scFv's, or even to be 10-fold increased when the polypeptide linker covalently linking $V_H$ and $V_L$ was removed, thus generating two proteins each consisting of a $V_H$ directly and covalently linked to a $V_L$ not pairing with the $V_H$. This strategy of producing bispecific antibody fragments was also described in several patent applications. Patent application WO 94/09131 (SCOTGEN LTD; priority date Oct. 15, 1992) relates to a bispecific binding protein in which the binding domains are derived from both a $V_H$ and a $V_L$ region either present at two chains or linked in an scFv, whereas other fused antibody domains, e.g. C-terminal constant domains, are used to stabilise the dimeric constructs. Patent application WO 94/13804 (CAMBRIDGE ANTIBODY TECHNOLOGY/MEDICAL RESEARCH COUNCIL; first priority date Dec. 4, 1992) relates to a polypeptide containing a $V_H$ and a $V_L$ which are incapable of associating with each other, whereby the V-domains can be connected with or without a linker.

Mallender and Voss, 1994 (also described in patent application WO 94/13806; DOW CHEMICAL CO; priority date Dec. 11, 1992) reported the in vivo production of a single-chain bispecific antibody fragment in E. coli. The bispecificity of the bivalent protein was based on two previously produced monovalent scFv molecules possessing distinct specificities, being linked together at the genetic level by a flexible polypeptide linker. Traditionally, whenever single-chain antibody fragments are referred to, a single molecule consisting of one heavy chain linked to one (corresponding) light chain in the presence or absence of a polypeptide linker is implicated. When making bivalent or bispecific antibody fragments through the "diabody" approach (Holliger et al., (1993) and patent application WO 94/09131) or by the "double scFv" approach (Mallender and Voss, 1994 and patent application WO 94/13806), again the $V_H$ is linked to a (the corresponding) $V_L$.

The multispecific molecules described above can be made by a number of methods. For example, all specificities can be encoded in the same vector and expressed and assembled in the same host cell. This method is particularly useful where the multispecific molecule is a mAb X mAb, mAb X Fab, Fab X F(ab')$_2$ or ligand X Fab fusion protein. Various other methods for preparing bi- or multivalent antibodies are described for example described in U.S. Pat. Nos. 5,260, 203; 5,455,030; 4,881,175; 5,132,405; 5,091,513; 5,476, 786; 5,013,653; 5,258,498; and 5,482,858.

By using a bispecific or multispecific binding polypeptide according to the invention the invention offers several advantages as compared to monospecific/monovalent binding polypeptides.

It may be preferred that the at least one other binding domain is capable of binding an immunoactive cell, such as a leucocyte, a macrophage, a lymphocyte, a basophilic cell, and/or an eosinophilic cell, in order to increase the effect of the binding polypeptide in a therapeutic method. This may be accomplished by establishing that the at least one other binding domain is capable of specifically binding a mammalian protein, such as a human protein, such as a protein selected from any of the cluster differentiation proteins (CD), in particular CD64 and/or CD89. A method for producing bispecific antibodies having CD64 specificity is described in U.S. Pat. No. 6,071,517 to Medarex, Inc. The production and characterization of these preferred monoclonal antibodies are described by Fanger et al. in WO 88/00052 and in U.S. Pat. No. 4,954,617.

While human monoclonal antibodies are preferred, other antibodies which can be employed in the bispecific or multispecific molecules of the invention are murine, chimeric and humanized monoclonal antibodies. Such murine, chimeric and humanized monoclonal antibodies can be prepared by methods known in the art.

Bispecific and multispecific molecules of the present invention can be made using chemical techniques (see e.g., D. M. Kranz et al. (1981) *Proc. Natl. Acad. Sci. USA* 78:5807), "polydoma" techniques (see U.S. Pat. No. 4,474,893), or recombinant DNA techniques.

When the binding specificities are antibodies, they can be conjugated via sulfhydryl bonding of the C-terminus hinge regions of the two heavy chains. In a particularly preferred embodiment, the hinge region is modified to contain an odd number of sulfhydryl residues, preferably one, prior to conjugation.

Alternatively, both binding specificities can be encoded in the same vector and expressed and assembled in the same host cell. This method is particularly useful where the bispecific and multispecific molecule is a mAb×mAb, mAb× Fab, Fab×F(ab')$_2$ or ligand x Fab fusion protein. A bispecific and multispecific molecule of the invention, e.g., a bispecific molecule can be a single chain molecule, such as a single chain bispecific antibody, a single chain bispecific molecule comprising one single chain antibody and a binding determinant, or a single chain bispecific molecule comprising two binding determinants. Bispecific and multispecific molecules can also be single chain molecules or may comprise at least two single chain molecules. Methods for preparing bi- and multispecific molecules are described for example in U.S. Pat. No. 5,260,203; U.S. Pat. No. 5,455,030; U.S. Pat. No. 4,881,175; U.S. Pat. No. 5,132,405; U.S. Pat. No. 5,091,513; U.S. Pat. No. 5,476,786; U.S. Pat. No. 5,013,653; U.S. Pat. No. 5,258,498; and U.S. Pat. No. 5,482,858.

Binding of the bispecific and multispecific molecules to their specific targets can be confirmed by enzyme-linked immunosorbant assay (ELISA), a radioimmunoassay (RIA), FACS analysis, a bioassay (e.g., growth inhibition), or a Western Blot Assay. Each of these assays generally detects the presence of protein-antibody complexes of particular interest by employing a labeled reagent (e.g., an antibody) specific for the complex of interest. For example, the FcR-antibody complexes can be detected using e.g., an enzyme-linked antibody or antibody fragment which recognizes and specifically binds to the antibody-FcR complexes. Alternatively, the complexes can be detected using any of a variety of other immunoassays. For example, the antibody can be radioactively labeled and used in a radioimmunoassay (RIA) (see, for example, Weintraub, B., Principles of Radioimmunoassays, Seventh Training Course on Radioligand Assay Techniques, The Endocrine Society, March, 1986). The radioactive isotope can be detected by such means as the use of a y counter or a scintillation counter or by autoradiography.

Humanised Antibody Framework

It is not always desirable to use non-human antibodies for human therapy, since the non-human "foreign" epitopes may elicit immune response in the individual to be treated. To eliminate or minimize the problems associated with non-human antibodies, it is desirable to engineer chimeric antibody derivatives, i.e., "humanized" antibody molecules that combine the non-human Fab variable region binding determinants with a human constant region (Fc). Such antibodies are characterized by equivalent antigen specificity and affinity of the monoclonal and polyclonal antibodies described above, and are less immunogenic when administered to humans, and therefore more likely to be tolerated by the individual to be treated.

Humanised antibodies are in general chimeric antibodies comprising regions derived from a human antibody and regions derived from a non-human antibody, such as a rodent antibody. Humanisation (also called Reshaping or CDR-grafting) is a well-established technique for reducing the immunogenicity of monoclonal antibodies (mAbs) from xenogeneic sources (commonly rodent), increasing the homology to a human immunoglobulin, and for improving their activation of the human immune system. Thus, humanized antibodies are typically human antibodies in which some CDR residues and possibly some framework residues are substituted by residues from analogous sites in rodent antibodies.

It is further important that humanized antibodies retain high affinity for the antigen and other favourable biological properties. To achieve this goal, according to a preferred method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of certain residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is maximized, although it is the CDR residues that directly and most substantially influence antigen binding.

One method for humanising MAbs related to production of chimeric antibodies in which an antigen binding site comprising the complete variable domains of one antibody are fused to constant domains derived from a second antibody, preferably a human antibody. Methods for carrying out such chimerisation procedures are for example described in EP-A-0 120 694 (Celltech Limited), EP-A-0 125 023 (Genentech Inc.), EP-A-0 171 496 (Res. Dev. Corp. Japan), EP-A-0173494 (Stanford University) and EP-A-0 194 276 (Celltech Limited). A more complex form of humanisation of an antibody involves the re-design of the variable region domain so that the amino acids constituting the non-human antibody binding site are integrated into the framework of a human antibody variable region (Jones et al., 1986).

The humanized antibody of the present invention may be made by any method capable of replacing at least a portion of a CDR of a human antibody with a CDR derived from a non-human antibody. Winter describes a method which may be used to prepare the humanized antibodies of the present invention (UK Patent Application GB 2188638A, filed on Mar. 26, 1987), the contents of which is expressly incorporated by reference. The human CDRs may be replaced with non-human CDRs using oligonucleotide site-directed mutagenesis as described in the examples below.

As an example the humanized antibody of the present invention may be made as described in the brief explanation below. The humanized antibodies of the present invention may be produced by the following process:

(a) constructing, by conventional techniques, an expression vector containing an operon with a DNA sequence encoding an antibody heavy chain in which the CDRs and such minimal portions of the variable domain framework region that are required to retain antibody binding specificity are derived from a non-human immunoglobulin, and the remaining parts of the antibody chain are derived from a human immunoglobulin, thereby producing the vector of the invention;

(b) constructing, by conventional techniques, an expression vector containing an operon with a DNA sequence encoding a complementary antibody light chain in which the CDRs and such minimal portions of the variable domain framework region that are required to retain donor antibody binding specificity are derived from a non-human immunoglobulin, and the remaining parts of the antibody chain are derived from a human immunoglobulin, thereby producing the vector of the invention;

(c) transfecting the expression vectors into a host cell by conventional techniques to produce the transfected host cell of the invention; and (d) culturing the transfected cell by conventional techniques to produce the humanised antibody of the invention.

The host cell may be cotransfected with the two vectors of the invention, the first vector containing an operon encoding a light chain derived polypeptide and the second vector containing an operon encoding a heavy chain derived polypeptide. The two vectors contain different selectable markers, but otherwise, apart from the antibody heavy and light chain coding sequences, are preferably identical, to ensure, as far as possible, equal expression of the heavy and light chain polypeptides. Alternatively, a single vector may be used, the vector including the sequences encoding both the light and the heavy chain polypeptides. The coding sequences for the light and heavy chains may comprise cDNA or genomic DNA or both.

The host cell used to express the altered antibody of the invention may be either a bacterial cell such as *E. coli*, or a eukaryotic cell. In particular a mammalian cell of a well defined type for this purpose, such as a myeloma cell or a Chinese hamster ovary cell may be used.

The general methods by which the vectors of the invention may be constructed, transfection methods required to produce the host cell of the invention and culture methods required to produce the antibody of the invention from such host cells are all conventional techniques. Likewise, once produced, the humanized antibodies of the invention may be purified according to standard procedures as described below.

Antigenic epitope(s) such as the O-glycosylated peptides of the invention may be administered to a mammal in an amount sufficient to stimulate an immunological response against the antigenic epitope(s). The antigenic epitope(s) may be combined in a therapeutic composition and administered in several doses over a period of time that optimizes the immunological response of the mammal. Such an immunological response can be detected and monitored by observing whether antibodies directed against the epitopes of the invention are present in the bloodstream of the mammal.

Such antibodies can be used alone or conjugated to, or combined with, therapeutically useful agents. Antibodies can be administered to mammals suffering from any cancer that displays the cancer-associated epitope(s). Such administration can provide both therapeutic treatment, and prophylactic or preventative measures. For example, therapeutic methods can be used to determine the spread of a cancer and lead to its remission.

Antibodies of the invention can be used for passive immunization of patient, i.e. administering the antibodies or as antibody fragments such as Fab fragments in isolated form to the patient. Furthermore, medicaments such as toxins or chemotherapeutic agents can be conjugated to the antibodies of the invention by methods known to those skilled in the art. All of the above antibodies can subsequent to administration target cancer cells specifically, based on the knowledge that the pattern of multiple and aberrantly O-glycosylated mucins on cancer cells distinguishes them from healthy cells.

Therapeutically useful agents which may be conjugated to the antibodies of the invention include but is not limited to the group comprising adrimycin, aminoglutethimide, aminopterin, azathioprine, bleomycin sulfate, bulsulfan, carboplatin, caminomycin, carmustine, chlorambucil, cisplatin, cyclophosphamide, cyclosporine, cytarabidine, cytosine arabinoside, cytoxin dacarbazine, dactinomycin, daunomycin, daunorubicin, doxorubicin, esperamicins, etoposide, fluorouracil, ifosfamide, interferon-α, lomustine, melphalan, mercaptopurine, methotrexate, mitomycin C, mitotane, mitoxantrone, procarbazine HCl, taxol, taxotere (docetaxel), teniposide, thioguanine, thiotepa, vinblastine sulfate, vincristine sulfate and vinorelbine. Additional agents include those disclosed in Chapter 52, Antineoplastic Agents (Paul Calabresi and Bruce A. Chabner), and the introduction thereto, pp. 1202-1263, of Goodman and Gilman's "The Pharmacological Basis of Therapeutics", Eighth Edition, 1990, McGraw-Hill, Inc. (Health Professions Division). Toxins can be proteins such as, for example, pokeweed anti-viral protein, cholera toxin, pertussis toxin, ricin, gelonin, abrin, diphtheria exotoxin, or *Pseudomonas* exotoxin. Toxin moieties can also be high energy-emitting radionuclides such as cobalt-60, I-131, I-125, Y-90 and Re-186, and enzymatically active toxins of bacterial, fungal, plant or animal origin, or fragments thereof.

Chemotherapeutic agents can be used to reduce the growth or spread of cancer cells and tumors that express the tumor associated epitope of the invention. Animals that can be treated by the chemotherapeutic agents of the invention include humans, non-human primates, cows, horses, pigs, sheep, goats, dogs, cats, rodents and the like. In all embodiments human tumor antigens and human subjects are preferred.

Species-dependent antibodies can be used in therapeutic methods. Such a species-dependent antibody has constant regions that are substantially non-immunologically reactive with the chosen species. Such species-dependent antibody is particularly useful for therapy because it gives rise to substantially no immunological reactions. The species-dependent antibody can be of any of the various types of antibodies as defined above, but preferably is mammalian, and more preferably is a humanized or human antibody.

The present inventors have found glycopeptide epitopes associated with colorectal cancer and antibodies useful in detecting said glycopeptides.

In another aspect, the present invention relates to a method for detecting colorectal cancer, said method comprising (i) contacting a sample from said host organism with one or more O-glycosylated mucin peptides, wherein said peptide comprises, or said peptides comprise, at least 5 consecutive amino acid residues of a mucin, or a fragment or variant thereof, wherein said variant is at least 70% identical, such as at least 75% identical to, e.g. at least 80% identical to, such as at least 85% identical to, e.g. at least 90% identical to, such as at least 95% identical to, e.g. at least 98% identical to, such as at least 99% identical to said at least 5 consecutive amino acid residues of said mucin, and
(ii) removing unbound sample, and
(iii) qualitatively and/or quantitatively characterise the bound material, wherein antibodies bound to said peptides indicate cancer in the host organism.

The present inventors have raised several antibodies specific for different glycosylated parts of the mucin proteins. Accordingly, in one aspect the present invention relates to a method for detecting cancer, said method comprising
(i) contacting a sample with one or more antibodies capable of recognising one or more O-glycosylated mucin peptides, wherein said peptide comprises at least 5 consecutive amino acid residues of a mucin, or a fragment or variant thereof, wherein said variant is at least 70% identical, such as at least 75% identical to, e.g. at least 80% identical to, such as at least 85% identical to, e.g. at least 90% identical to, such as at least 95% identical to, e.g. at least 98% identical to, such as at least 99% identical to said at least 5 consecutive amino acid residues of said mucin, and
(ii) removing unbound sample and/or unbound antibody, and
(iii) qualitatively and/or quantitatively characterise the bound material, wherein peptides bound to said antibodies indicate cancer in the sample host.

In one embodiment said O-glycosylated mucin peptide is selected from the group consisting of
a) MUC4 Tn selected from the group consisting of
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 23), wherein the asterisk (*) indicates a potential O-glycosylation site, wherein the optional glycan is Tn (GalNAc-α-Ser/Thr), or
b) a MUC4 non glycosylated mucin peptide selected from the group consisting of
PVTSPSSASTGHTTPLPVTDTSSASTGDTTP (SEQ ID NO: 18), LPVTSLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21) STGDTLPLPVTDTSSV (SEQ ID NO: 22), PVTYASSASTGDTTPLPVTDTSSVSTGHAT (SEQ ID NO: 23), or a Tn glycosylated mucin peptide selected from the group consisting of
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T*GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T*GHAT* (SEQ ID NO: 22), wherein the asterisk (*) indicates a potential O-glycosylation site, wherein the optional glycan is Tn (GalNAc-α-Ser/Thr), or c) a Tn glycosylated MUC4 peptide selected from the group consisting of
PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO: 7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates a potential O-glycosylation site, wherein the optional glycan is Tn (GalNAc-α-Ser/Thr), or
d) an all-Tn MUC4 peptide selected from the group consisting of
PVT*S*PS*S*AS*T*GHT*T*PLPVT*DT*S*S*AS*T*GDT*T*P (SEQ ID NO: 18), LPVT*S*LS*S*VS*T*GDT*T*PLPVT*S*PS*S*AS*T*GH (SEQ ID NO: 19), LPVT*S*PS*S*AS*T*GHAS*PLLVT*DAS*S*AS*T*GQ (SEQ ID NO: 20), S*T*GDT*LPLPVT*DT*S*S*V (SEQ ID NO: 22), PVT*YAS*S*AS*T*GDT*T*PLPVT*DT*S*S*VS*T*GHAT* (SEQ ID NO: 23) and
PMT*DT*KTV*T*T*PGS*S*FT*AS*GHS*PS*EIVPQ DAPT*IS*AAT*ZFAPAPT*GNGHT*
T*QAPT*T*ALQAAPS*S*HDAT*LGPS*GGT*S*LS* KT*GALT*LANS*VVS*T*PGGPEG
QWT*S*AS*AS*T*S*PDT*AAAMT*HT*HQAES*T* EAS*GQT*QT*S*EPAS*S*GS*RT*T*
S*AGT*AT*PS*S*S*GAS*GT*T*PS*GS*EGIS*T*S* GET*T*RFS*S*NPS*RDS*HT*T* (SEQ ID NO: 30), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), GS*EGIS*T*S*GET*T*RFS*S*N (SEQ ID NO: 16) and GET*T*RFS*S*NPS*RDS*HT*T* (SEQ ID NO: 17), wherein the asterisk (*) indicates an O-glycosylation site, wherein the glycan is Tn (GalNAc-α-Ser/Thr), or
e) a recombinant MUC4 Tn having the sequence
PMT*DT*KTV*T*T*PGS*S*FT*AS*GHS*PS*EIVPQ DAPT*IS*AAT*ZFAPAPT*GNGHT*
T*QAPT*T*ALQAAPS*S*HDAT*LGPS*GGT*S*LS* KT*GALT*LANS*VVS*T*PGGPEG
QWT*S*AS*AS*T*S*PDT*AAAMT*HT*HQAES*T* EAS*GQT*QT*S*EPAS*S*GS*RT*T*
S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is Tn (GalNAc-α-Ser/Thr), or f) a MUC1Tn/STn/Core3 glycosylated or MUC4 glycosylated mucin peptide selected from the group consisting of VT(Tn)S(Tn)APDT(Tn)RPAPGS(Tn)T(Tn)APPAHG, VT(STn)S(STn)APDT(STn)RPAPGS(STn)T(STn) APPAHG, VT(Core3)S(Core3)APDT(Core3)RPAPGS(Core3)T(Core3)APPAHG, PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S*AS*T* GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T*GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23), and PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), or g) a MUC1 STn and a MUC4 selected from the group consisting of VT(STn)S(STn)APDT(STn)RPAPGS(STn)T(STn) APPAHG, PVT*S*PS*S*AS*T*GHT*T*PLPVT*DT*S*S*AS*T* GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22) and PVT*YAS*S*AS*T*GDT*T*PLPVT*DT*S*S*VS*T* GHAT* (SEQ ID NO: 23), and wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

In one aspect the present invention relates to a method for detecting a gastrointestinal disease in a host organism wherein said disease is characterised in that O-glycosylated mucin peptides are shed from the diseased host and secreted in the gastrointestinal tract of the sample organism suffering from the disease, said method comprising (i) contacting a sample from said host organism with one or more antibodies capable of recognising said O-glycosylated mucin peptides, and (ii) removing unbound sample, and (iii) qualitatively and/or quantitatively characterise the bound material, wherein peptides bound to the antibodies of step (i) are indicative of disease or disorder in the host organism.

In another aspect the present invention relates to a method for detecting a gastrointestinal disease in a host organism wherein said disease is characterised in that O-glycosylated mucin peptides are shed from the diseased cells of the host into an extracellular volume, such as secreted into, the lumen of the bladder, milk ducts of the breast, lumen of the uterus, the vagina, into pancreatic fluid, into ascites fluid, onto bronchiolar surface of the lung, ductal surfaces of the prostate, lumen of the seminiferous tubules, the oesophagus or the gastrointestinal tract of the sample organism suffering from the disease, said method comprising (i) contacting a sample from said host organism with one or more antibodies capable of recognising said O-glycosylated mucin peptides, and (ii) removing unbound sample, and (iii) qualitatively and/or quantitatively characterise the bound material, wherein peptides bound to the antibodies of step (i) are indicative of disease or disorder in the host organism.

In one embodiment the disease detected by the above method is cancer wherein the cancer is selected from the group consisting of colorectal cancer, breast cancer, oral cancer, gastric cancer, esophageal cancer, pancreatic cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

In one embodiment the disease detected by the above method is colorectal cancer.

In one embodiment of the above method, the antibody the present invention is capable of recognising at least one O-glycosylated peptide, said peptide comprising at least 5 consecutive amino acid residues of a mucin selected from the group consisting of MUC1 Variant CT58, MUC1 Variant CT80, MUC1 Variant SEC, MUC1 Variant X, MUC1 Variant Y, MUC1 Variant ZD, MUC2, MUC3A, MUC3B, MUC4, MUC5AC, MUC5B, MUC6, MUC7, MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin.

In one embodiment of the present invention the at least 5 consecutive amino acid residues of a mucin as defined herein above are from a mucin selected from the group consisting of MUC1 Variant CT58, MUC1 Variant CT80, MUC1 Variant SEC, MUC1 Variant X, MUC1 Variant Y, MUC1 Variant ZD, MUC2, MUC3A, MUC3B, MUC4, MUC5AC, MUC5B, MUC6, MUC7, MUC8, MUC9, MUC10, MUC11, MUC12, MUC13, MUC14, MUC15, MUC16, MUC17, MUC18, MUC19, MUC20, MUC21 and MUC-HEG.

In one embodiment the antibody is capable of recognising at least one O-glycosylated peptide variant wherein said variant is at least 70% identical a peptide selected from the group consisting of PMTDTKTVTTPGSSFTA (SEQ ID NO: 3), PGSSFTASGHSPSEIVPQD (SEQ ID NO: 4), SEIVPQDAPTISAATTFAPA (SEQ ID NO: 5), TTFAPAPT-GNGHTTQAPTTA (SEQ ID NO: 6), TTQAPT-TALQAAPSSHD (SEQ ID NO: 7), APSSHDATLGPSGGT-SLSKT (SEQ ID NO: 8), SLSKTGALTLANSVVSTP (SEQ ID NO: 9), NSVVSTPGGPEGQWTSASAS (SEQ ID NO: 10), TSASASTSPRTAAAMTHT (SEQ ID NO: 11), AAAMTHTHQAESTEASGQT (SEQ ID NO: 12), EAS-GQTQTSEPASSGSRTT (SEQ ID NO: 13), PASSGSRTT-SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), STGDTLPLPVTDTSSV (SEQ ID NO: 22), PVTYASSASTGDTTPLPVTDTSSVSTGHAT (SEQ ID NO: 23), VTSAPDTRPAPGSTAPPAHG (SEQ ID NO: 24), and PTTTPITTTTVTPTPTPTGTQTPTTTPISTTC (SEQ ID NO:25).

In another embodiment the antibody is capable of recognising an O-glycosylated mucin peptide selected from the group consisting of VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3)RPAPGS(Core3)T(Core3)APPAHG (MUC1-15Core3), VT(STn)S(STn)APDT(STn)RPAPGS(STn)T(STn)APPAHG (MUC 1 (15STn), VT(STn)SAPDTRPAPGS(STn)T(STn)APPAHG (MUC1 9STn), VT(Tn)S(Tn)APDT(Tn)RPAPGS(Tn)T(Tn)APPAHG (MUC1 15Tn), VT(Tn)SAPDTRPAPGS(Tn)T(Tn)APPAHG (MUC1 9Tn), VT(Tn)SAPDTRPAPGST(Tn)APPAHG (MUC1 6Tn), PMT*DT*KT*VT*T*PGS*S*FT*A (SEQ ID NO:3), PGS*S*FT*AS*GHS*PS*EIVPQD (SEQ ID NO: 4), S*EIVPQDAPT*IS*AAT*T*FAPA (SEQ ID NO: 5), T*T*FAPAPT*GNGHT*T*QAPT*T*A (SEQ ID NO: 6), T*T*QAPT*T*ALQAAPS*S*HD(SEQ ID NO:7), APS*S*HDAT*LGPS*GGT*S*LS*KT* (SEQ ID NO:8), S*LS*KT*GALT*LANS*VVS*T*P (SEQ ID NO: 9), NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17), PVT*S*PS*S*AS*T*GHT*T*PLPVT*DT*S*S* AS*T*GDT*T*P (SEQ ID NO: 18), LPVT*S*LS*S*VS*T*GDT*T*PLPVT*S*PS*S*AS*T* GH (SEQ ID NO: 19), LPVT*S*PS*S*AS*T*GHAS*PLLVT*DAS*S*AS*T* GQ (SEQ ID NO: 20), PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22), PVT*YAS*S*AS*T*GDT*T*PLPVT*DT*S*S*VS*T* GHAT* (SEQ ID NO: 23) PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30), wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr), and ST/sialyl-T (Neu5Acα2-3Galβ3GalNAc-Ser/Thr).

In one aspect the invention relates to a method for detecting colorectal cancer, said method comprising
(i) contacting a sample with a polyclonal antibody serum wherein said polyclonal antibody is capable of recognising at least two different O-glycosylated mucin peptides, wherein said peptides comprises at least 5 consecutive amino acid residues selected from the group consisting of MUC1 Variant CT58, MUC1 Variant CT80, MUC1 Variant SEC, MUC1 Variant X, MUC1 Variant Y, MUC1 Variant ZD, MUC2, MUC3A, MUC3B, MUC4, MUC5AC, MUC5B, MUC6, MUC7, MUC8, MUC9, MUC10, MUC11, MUC12, MUC13, MUC14, MUC15, MUC16, MUC17, MUC18, MUC19, MUC20, MUC21 and MUC-HEG, or a fragment or variant thereof, wherein said variant is at least 70% identical to said at least 5 consecutive amino acid residues of said mucin, and
(ii) removing unbound sample and/or unbound antibody, and
(iii) qualitatively and/or quantitatively characterise the bound material, wherein peptides bound to said antibodies indicate cancer in the sample host.

In one embodiment the at least two different O-glycosylated mucin peptides as defined herein above are a first O-glycosylated mucin peptide selected from the group consisting of PMTDTKTVTTPGSSFTA (SEQ ID NO: 3), PGSSFTASGHSPSEIVPQD (SEQ ID NO: 4), SEIVPQDAPTISAATTFAPA (SEQ ID NO: 5), TTFAPAPT-GNGHTTQAPTTA (SEQ ID NO: 6), TTQAPT-TALQAAPSSHD (SEQ ID NO: 7), APSSHDATLGPSGGT-SLSKT (SEQ ID NO: 8), SLSKTGALTLANSVVSTP (SEQ ID NO: 9), NSVVSTPGGPEGQWTSASAS (SEQ ID NO: 10), TSASASTSPRTAAAMTHT (SEQ ID NO: 11), AAAMTHTHQAESTEASGQT (SEQ ID NO: 12), EAS-GQTQTSEPASSGSRTT (SEQ ID NO: 13), PASSGSRTT-SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), PVTYASSASTGDTTPLPVTDTSSVSTGHAT (SEQ ID NO: 22), STGDTLPLPVTDTSSV (SEQ ID NO: 23) and PMTDTKTVTTPGSSFTASGHSPSEIVPQDAPTI- SAATZFAPAPTGNGHTTQAPTTALQ AAPSSHDATL-
GPSGGTSLSKTGALTLANSVVSTPGGPEGQWT-
SASASTSPDTAAAMT
HTHQAESTEASGQTQTSEPASSGSRTTSAGTATPSSS-
GASGTTPSGSEGISTSGETT RFSSNPS (SEQ ID NO: 30) wherein at least one serine and/or threonine residue is optionally O-glycosylated and wherein the optional glycan is selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and a second O-glycosylated mucin peptide selected from the group consisting of VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3)RPAPGS(Core3)T(Core3)APPAHG (MUC1-15Core3), VT(STn)S(STn)APDT(STn)RPAPGS(STn)T(STn) APPAHG (MUC 1 (15STn), VT(STn)SAPDTRPAPGS(STn)T(STn)APPAHG (MUC1 9STn), VT(Tn)S(Tn)APDT(Tn)RPAPGS(Tn)T(Tn)APPAHG (MUC1 15Tn), VT(Tn) SAPDTRPAPGS(Tn)T(Tn)APPAHG (MUC1 9Tn), VT(Tn) SAPDTRPAPGST(Tn)APPAHG (MUC1 6Tn) respectively, and
(ii) removing unbound sample, and
(iii) qualitatively and/or quantitatively characterise the bound material, wherein antibodies bound to said peptides indicate cancer in the sample host.

In one aspect the invention relates to a method for detecting cancer, said method comprising
(i) contacting a sample with at least one first and at least one second antibody, wherein said first antibody is capable of recognising a first mucin peptide selected from the group consisting of the O-glycosylated MUC1 peptides VTSAPDT(Core3)RPAPGSTAPPAHG (MUC1 Core3), VT(Core3)SAPDTRPAPGS(Core3)T(Core3)APPAHG (MUC1 9Core3), VT(Core3)S(Core3)APDT(Core3)RPAPGS(Core3)T(Core3)APPAHG (MUC1-15Core3), VT(STn)S(STn)APDT(STn)RPAPGS(STn)T(STn) APPAHG (MUC 1 (15STn), VT(STn)SAPDTRPAPGS(STn)T(STn)APPAHG (MUC1 9STn), VT(Tn)S(Tn)APDT(Tn)RPAPGS(Tn)T(Tn)APPAHG (MUC1 15Tn), VT(Tn) SAPDTRPAPGS(Tn)T(Tn)APPAHG (MUC1 9Tn), VT(Tn) SAPDTRPAPGST(Tn)APPAHG (MUC1 6Tn),
and wherein said second antibody is capable of recognising another mucin peptide selected from:
PMT*DT*KT*VT*T*PGS*S*FT*A (SEQ ID NO:3),
PGS*S*FT*AS*GHS*PS*EIVPQD (SEQ ID NO: 4),
S*EIVPQDAPT*IS*AAT*T*FAPA (SEQ ID NO: 5),
T*T*FAPAPT*GNGHT*T*QAPT*T*A (SEQ ID NO: 6),
T*T*QAPT*T*ALQAAPS*S*HD(SEQ ID NO:7),
APS*S*HDAT*LGPS*GGT*S*LS*KT* (SEQ ID NO:8),
S*LS*KT*GALT*LANS*VVS*T*P (SEQ ID NO: 9),
NS*VVS*T*PGGPEGQWT*S*AS*AS* (SEQ ID NO: 10), T*S*AS*AS*T*S*PRT*AAAMT*HT* (SEQ ID NO: 11), AAAMT*HT*HQAES*T*EAS*GQT*(SEQ ID NO: 12), EAS*GQT*QT*S*EPAS*S*GS*RT*T* (SEQ ID NO: 13), PAS*S*GS*RT*T*S*AGT*AT*PS*S*S* (SEQ ID NO: 14), T*AT*PS*S*S*GAS*GT*T*PS*GS*EGI (SEQ ID NO: 15), S*GS*EGIS*T*S*GET*T*RFS*S*N (SEQ ID NO: 16) and GET*T*RFS*S*NPS*RDS*HT*T* (SEQ ID NO: 17),
PVT*S*PS*S*AS*T*GHT*T*PLPVT*DT*S*S*AS*T* GDT*T*P (SEQ ID NO: 18),
LPVT*S*LS*S*VS*T*GDT*T*PLPVT*S*PS*S*AS*T* GH (SEQ ID NO: 19),
LPVT*S*PS*S*AS*T*GHAS*PLLVT*DAS*S*AS*T* GQ (SEQ ID NO: 20),
PLPVT*S*PS*S*AS*T*GHAS*PLLVT*DAS*S*AS*T* GQ (SEQ ID NO: 21), S*T*GDT*LPLPVT*DT*S*S*V (SEQ ID NO: 22),
PVT*YAS*S*AS*T*GDT*T*PLPVT*DT*S*S*VS*T* GHAT* (SEQ ID NO: 23)
PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30),
wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr), and
(ii) removing unbound sample and/or unbound antibody), and
(iii) qualitatively and/or quantitatively characterise the bound material, wherein peptides bound to said antibodies indicate cancer in the sample host.

In another aspect the invention relates to a method for detecting cancer, said method comprising
(i) contacting a sample with at least one antibody, wherein said antibody is capable of recognising a glycosylated mucin peptide, wherein said peptide comprises at least 5 consecutive amino acid residues of a mucin selected from the group consisting of MUC4 (SEQ ID NO: 1) and/or MUC1 (SEQ ID NO: 2), or a fragment or variant thereof, wherein said variant is at least 70% identical to said at least 5 consecutive amino acid residues of said mucin selected from the group consisting of MUC4 (SEQ ID NO: 1) and/or MUC1 (SEQ ID NO: 2), and
(ii) removing unbound sample and/or unbound antibody, and
(iii) qualitatively and/or quantitatively characterise the bound material, wherein peptides bound to said antibodies indicate cancer in the sample host.

In one aspect the invention relates to a method for detecting colorectal cancer, said method comprising
(i) contacting a sample with at least one antibody, wherein said antibody is capable of recognising a glycosylated mucin peptide selected from the group consisting of
PMTDTKTVTTPGSSFTA (SEQ ID NO: 3), PGSSFTAS-GHSPSEIVPQD (SEQ ID NO: 4), SEIVPQDAPTISAAT-TFAPA (SEQ ID NO: 5), TTFAPAPTGNGHTTQAPTTA (SEQ ID NO: 6), TTQAPTTALQAAPSSHD (SEQ ID NO: 7), APSSHDATLGPSGGTSLSKT (SEQ ID NO: 8), SLSK-TGALTLANSVVSTP (SEQ ID NO: 9), NSVVSTPGG-PEGQWTSASAS (SEQ ID NO: 10), TSASAST-SPRTAAAMTHT (SEQ ID NO: 11), AAAMTHTHQAESTEASGQT (SEQ ID NO: 12), EAS-GQTQTSEPASSGSRTT (SEQ ID NO: 13), PASSGSRTT-SAGTATPSSS (SEQ ID NO: 14), TATPSSSGAS-GTTPSGSEGI (SEQ ID NO: 15), SGSEGISTSGETTRFSSN (SEQ ID NO: 16), GETTRFSS-NPSRDSHTT (SEQ ID NO: 17), PVTSPSSAST-GHTTPLPVTDTSSASTGDTTP (SEQ ID NO: 18), LPVT-SLSSVSTGDTTPLPVTSPSSASTGH (SEQ ID NO: 19), LPVTSPSSASTGHASPLLVTDASSASTGQ (SEQ ID NO: 20), PLPVTSPSSASTGHASPLLVTDASSASTGQ (SEQ ID NO: 21), PVTYASSASTGDTTPLPVTDTSSVSTGHAT (SEQ ID NO: 22), STGDTLPLPVTDTSSV (SEQ ID NO: 23), VTSAPDTRPAPGSTAPPAHG (SEQ ID NO: 24), and PTTTPITTTTTVTPTPTPTGTQTPTTTPISTTC (SEQ ID NO:25) or a fragment of said peptides, or variants of said peptides in which variants any amino acid has been changed to a different amino acid, provided that no more than 5 of the amino acid residues in the sequence are so changed, and
(ii) removing unbound sample and/or unbound antibody, and
(iii) qualitatively and/or quantitatively characterise the bound material, wherein peptides bound to said antibodies indicate cancer in the sample host.

In another aspect the invention relates to a method for detecting colorectal cancer, said method comprising
(i) contacting a sample with at least two different antibodies, wherein said antibodies are capable of recognising two different glycosylated mucin peptides, wherein said peptide comprises at least 5 consecutive amino acid residues of a mucin selected from the group consisting of MUC4 (SEQ ID NO:1), MUC1 (SEQ ID NO: 2), MUC2 (SEQ ID NO: 26), MUC5AC (SEQ ID NO: 27), MUC6 (SEQ ID NO: 28), and MUC7 (SEQ ID NO: 29) or a naturally occurring fragment or variant of said mucin, wherein said variant is at least 70% identical to said at least 5 consecutive amino acid residues of said mucin, and
(ii) removing unbound sample and/or unbound antibody, and
(iii) qualitatively and/or quantitatively characterise the bound material, wherein peptides bound to said antibodies indicate cancer in the sample host.

The antibodies of the present invention have been raised against different parts of glycosylated mucin polypeptides, Thus in one main aspect, the present invention relates to a an antibody, in particular a monoclonal antibody as defined in the claim 1 to 5. The invention also relates to antigen binding fragment of said antibody, wherein said antibody or the antigen binding fragment of said antibody is capable of specifically recognising a mucin glycopeptide as defined in any of the claims.

In one embodiment the antibody is selected from the group consisting of IgA, IgG, IgD, IgE and IgM antibodies.

In a further embodiment the IgA antibody is an IgA1 or an IgA2 antibody.

In a further embodiment the IgG antibody is selected from the group consisting of IgG1, IgG2, IgG3 and IgG4 antibodies.

In a further embodiment the IgG antibody is selected from the group consisting of mouse IgG1, mouse IgG2A, mouse IgG2B and mouse IgG3 antibodies.

In a further embodiment the IgG antibody is selected from the group consisting of human IgG1, human IgG2, human IgG3 and human IgG4 antibodies.

In a further embodiment the IgG antibody is selected from the group consisting of rabbit IgG1, rabbit IgG2A, rabbit IgG2B and rabbit IgG3 antibodies.

In a further embodiment the IgG antibody is selected from the group consisting of goat IgG1, goat IgG2A, goat IgG2B and goat IgG3 antibodies.

In one embodiment the antibodies of the invention is raised using any other mammal suitable, as known to the person skilled in the art, for the purpose of raising antibodies.

In one embodiment the antibody of the present invention is selected from the group consisting of MAb 5C10, MAb 3C9, MAb 4D9, MAb 6C11 and MAb 6E3.

In one embodiment the antibody is MAb 4D9 deposited under the Budapest Treaty with HPA Cultures collection under Customer Account Number: 202327, Customer Purchase Order Number: 29979812, HPA Culture Collections Reference Number: Q8427 and accession number 09120102.

In one embodiment the antibody is MAb 5C10 deposited under the Budapest Treaty with HPA Cultures collection under Customer Account Number: 202327, Customer Purchase Order Number: 29979812, HPA Culture Collections Reference Number: Q8427 and accession number 09120101.

In one embodiment the antibody is MAb 6E3 deposited under the Budapest Treaty with HPA cultures under Customer Account Number: 202327, Customer Purchase Order Number: 29979812, HPA Culture Collections Reference Number: Q8427 and accession number 09120103.

In one embodiment the antibody is MAb 3C9.

In one embodiment the antibody is MAb 6C11.

In embodiment the MAb 5C10 antibody as defined herein above binds to one or more amino acid residues of the glycosylated MUC1 epitope having the sequence VTSAPDT(Core3)RPAPGSTAPPAHG (SEQ ID NO: 24)

In embodiment the MAb 4D9 antibody as defined herein above binds to one or more amino acid residues of the glycosylated MUC4 epitope having the sequence PVT*YAS*S*AS*T*GDT*T*PLPVT*DT*S*S*VS*T* GHAT* (SEQ ID NO: 23) wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

In embodiment the MAb 3C9 antibody as defined herein above binds to one or more amino acid residues of the glycosylated MUC4 epitope having the sequence PVT*YAS*S*AS*T*GDT*T*PLPVT*DT*S*S*VS*T* GHAT* (SEQ ID NO: 23) wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

In embodiment the MAb 6C11 antibody as defined herein above binds to one or more amino acid residues of the glycosylated MUC4 epitope having the sequence PVT*YAS*S*AS*T*GDT*T*PLPVT*DT*S*S*VS*T* GHAT* (SEQ ID NO: 23) wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAc-α-Ser/Thr), and ST/sialyl-T (Neu5Acα2-3Galβ3GalNAc-Ser/Thr).

In embodiment the MAb 6E3 antibody as defined herein above binds to one or more amino acid residues of the glycosylated MUC4 epitope having the sequence PMT*DT*KTV*T*T*PGS*S*FT*AS*GHS*PS*EIVPQ DAPT*IS*AAT*ZFAPAPT*GNGHT* T*QAPT*T*ALQAAPS*S*HDAT*LGPS*GGT*S*LS* KT*GALT*LANS*VVS*T*PGGPEG QWT*S*AS*AS*T*S*PDT*AAAMT*HT*HQAES*T* EAS*GQT*QT*S*EPAS*S*GS*RT*T* S*AGT*AT*PS*S*S*GAS*GT*T*PS*GS*EGIS*T*S* GET*T*RFS*S*NPS*RDS*HT*T* (SEQ ID NO: 30)

wherein the asterisk (*) indicates a potential O-glycosylation site, wherein the optional glycan is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)) Core-4 (GlcNAcβ1-3 (GlcNAcβ1-6)GalNAc-α-Ser/Thr), and ST/sialyl-T (Neu5Acα2-3Galβ3GalNAc-Ser/Thr).

Antibodies can be used as carriers for functional groups conjugated to the antibodies.

The functional groups may be for example agents suitable for detection by imaging methods or toxins useful in killing or destroying cells, for example cancer cells.

In one aspect the present invention relates to a method of detecting a peptide and/or an antibody as defined herein above, said method comprising conjugating an imaging agent to said peptide or antibody.

In one embodiment said imaging agent is detectable by at least one of the technologies selected from the group consisting of: computer tomography, ultrasound, magnetic resonance, nuclear imaging, optical and/or electron optical imaging.

In a further embodiment said optical and/or electron optical imaging is selected from the group consisting of diffuse optical tomography, optical coherence tomography, confocal laser scanning, microscopy, electron microscopy, fluorescence correlation microscopy, fluorescence resonance energy transfer, and fluorescence lifetime imaging.

In a further embodiment said nuclear imaging is selected from the group consisting of PET, SPECT and MRI.

In one embodiment said imaging agent is selected from the group consisting of antibodies, small molecules, peptides and metal ions, wherein said metal ion is selected from ions of transition metals or lanthanides and actinides.

In one embodiment the metal ion is an ion of Hf, Ho or Gd.

In one embodiment the antibody of the present invention, further comprises a toxin conjugated to said antibody.

The antibodies of the present invention have been raised against different parts of glycosylated mucin polypeptides, Thus in one aspect, the present invention relates to a monoclonal antibody or an antigen binding fragment of said antibody, wherein said antibody or the antigen binding fragment of said antibody is capable of specifically recognising a mucin glycopeptide as defined herein above.

The method used by the present inventors for raising antibodies is also part of the invention. Thus, in one aspect, the present invention relates to a method for producing the antibody defined herein above, said method comprising the steps of:
  i) providing a host organism,
  ii) immunizing the host organism with an O-glycosylated mucin as defined herein above, and
  iii) obtaining said antibody.

The present invention is applicable to a subject undergoing therapy, such as surgery.

In surgery the glycopeptides epitopes identified by the present inventors can be targeted with antibodies of the invention wherein the antibodies are conjugated to a visualization label, such as a fluorescent label. The epitopes can thus be visualised during surgery with the effect of more efficiently removing e.g. cancer tumours.

Accordingly, in one aspect, the present invention relates to a method for detecting a cancer tumour in a patient undergoing therapy and/or examination, said method comprising the steps of:

(i) administering to an area of the patient, the antibody as defined herein above, or an antigen binding fragment of said antibody, suitably conjugated to a visualisation label, and
(ii) removing unbound antibodies, and
(iii) detecting antibodies bound to glycopeptide epitopes as defined herein above, wherein labelling indicates presence of a tumour.

In one embodiment of the present invention the therapy is surgery.

In one embodiment of the present invention the examination is examination for colorectal cancer.

In one embodiment of the present invention the examination for colorectal cancer is by visualisation means such as endoscopy.

Another aspect of the present invention is a method for the preparation of hybridoma cells, which secrete monoclonal antibodies specific for the immunogenic glycopeptide characterized in that a suitable mammal is immunized with the immunogenic glycopeptide, antibody-producing cells of said mammal are fused with cells of a continuous cell line, the hybrid cells obtained in the fusion are cloned, and cell clones secreting the desired antibodies are selected.

Still another aspect is a monoclonal antibody selected from the group consisting of a monoclonal antibody produced by the hybridoma cells prepared by the method described above, a monoclonal antibody prepared by molecular display techniques, such as mRNA display, ribosome display, phage display and covalent display against the immunogenic glycopeptide.

Traditionally, monoclonal antibodies have been prepared using hybridoma technology. However, alternative techniques such as mRNA display, ribosome display, phage display and covalent display are now available. These are all display techniques where a peptide library is selected against the immunogenic glycopeptide. Such techniques can e.g. be used to identify humanized or fully human antibodies.

In one embodiment, the monoclonal antibody binds the MUC4 or MUC1 glycopeptides specified herein, on cancer cells but not on a non-malignant counterpart. Preferably said antibody binds glycopeptide epitopes associated with colorectal cancer.

In one aspect, the present invention relates to a monoclonal antibody or an antigen binding fragment of said antibody, wherein said antibody or the antigen binding fragment of said antibody is capable of specifically recognising a mucin glycopeptide as defined herein above.

Quantitative and Qualitative Analysis of Bound Material

The step of the method of the present invention comprising qualitatively and/or quantitatively characterising the bound peptide or antibody is based on an ELISA-type, or ELISA-analogous method. ELISA-analogous methods may comprise using e.g. microbeads to which peptides or antibodies can be used. One example of a microbead method is the Luminex method (www.luminexcorp.com).

Enzyme-linked immunosorbant assay, also called ELISA, enzyme immunoassay or EIA, is a biochemical technique used mainly in immunology to detect the presence of an antibody or an antigen in a sample. The ELISA has been used as a diagnostic tool in medicine and plant pathology, as well as a quality control check in various industries. In simple terms, in ELISA an unknown amount of antigen is affixed to a surface, and then a specific antibody is washed over the surface so that it can bind to the antigen. This antibody is linked to an enzyme, and in the final step a substance is added that the enzyme can convert to some detectable signal. Thus in the case of fluorescence ELISA, when light of the appropriate wavelength is shone upon the sample, any antigen/antibody complexes will fluoresce so that the amount of antigen in the sample can be inferred through the magnitude of the fluorescence.

Performing an ELISA involves at least one antibody with specificity for a particular antigen. The sample with an unknown amount of antigen is immobilized on a solid support (usually a polystyrene microtiter plate) either non-specifically (via adsorption to the surface) or specifically (via capture by another antibody specific to the same antigen, in a "sandwich" ELISA). After the antigen is immobilized the detection antibody is added, forming a complex with the antigen. The detection antibody can be covalently linked to an enzyme, or can itself be detected by a secondary antibody which is linked to an enzyme through conjugation. Between each step the plate is typically washed with a mild detergent solution to remove any proteins or antibodies that are not specifically bound. After the final wash step the plate is developed by adding an enzymatic substrate to produce a visible signal, which indicates the quantity of antigen in the sample.

In one embodiment the step of qualitatively and/or quantitatively characterising bound material in the method of the present invention is by Enzyme-linked immunosorbant assay (ELISA).

In one embodiment the step of qualitatively and/or quantitatively characterising bound material in the method of the present invention is by a bead assay such as a Luminex assay.

Pharmaceutical Compositions and Administration Forms

The main routes of drug delivery, in the treatment method are intravenous, oral, and topical. Other drug-administration methods, such as intraveneous, subcutaneous and intramuscular injection or via inhalation, which are effective to deliver the drug to a target site or to introduce the drug into the bloodstream, are also contemplated.

The mucosal membrane to which the pharmaceutical preparation of the invention may be administered can be any mucosal membrane of the mammal to which the biologically active substance is to be given, e.g. in the nose, vagina, eye, mouth, genital tract, lungs, gastrointestinal tract, or rectum, preferably the mucosa of the nose, mouth or vagina.

Compounds of the invention may be administered parenterally, that is by intravenous, intramuscular, subcutaneous intranasal, intrarectal, intravaginal or intraperitoneal administration. The subcutaneous and intramuscular forms of parenteral administration are generally preferred. Appropriate dosage forms for such administration may be prepared by conventional techniques. The compounds may also be administered by inhalation, which is by intranasal and oral inhalation administration. Appropriate dosage forms for such administration, such as an aerosol formulation or a metered dose inhaler, may be prepared by conventional techniques.

The compounds according to the invention may be administered with at least one other compound. The compounds may be administered simultaneously, either as separate formulations or combined in a unit dosage form, or administered sequentially.

In one embodiment of the present invention, the dosage of the active ingredient of the pharmaceutical composition as defined herein above, is between 10 µg to 500 mg per kg body mass.

Formulations

Whilst it is possible for the compounds or salts of the present invention to be administered as the raw glycopeptide or antibody preparation, it is preferred to present them in the form of a pharmaceutical formulation. Accordingly, the present invention further provides a pharmaceutical formulation, for medicinal application or for use during in situ detection of autoantibodies or glycopeptides relating to disease. The pharmaceutical composition comprises a compound of the present invention or a pharmaceutically acceptable salt thereof, as herein defined, and a pharmaceutically acceptable carrier therefore.

The compounds of the present invention may be formulated in a wide variety of oral administration dosage forms. The pharmaceutical compositions and dosage forms may comprise the compounds of the invention or its pharmaceutically acceptable salt or a crystal form thereof as the active component. The pharmaceutically acceptable carriers can be either solid or liquid. Solid form preparations include powders, tablets, pills, capsules, cachets, suppositories, and dispersible granules. A solid carrier can be one or more substances which may also act as diluents, flavoring agents, solubilizers, lubricants, suspending agents, binders, preservatives, wetting agents, tablet disintegrating agents, or an encapsulating material.

Preferably, the composition will be about 0.5% to 75% by weight of a compound or compounds of the invention, with the remainder consisting of suitable pharmaceutical excipients. For oral administration, such excipients include pharmaceutical grades of mannitol, lactose, starch, magnesium stearate, sodium saccharine, talcum, cellulose, glucose, gelatin, sucrose, magnesium carbonate, and the like.

In powders, the carrier is a finely divided solid which is a mixture with the finely divided active component. In tablets, the active component is mixed with the carrier having the necessary binding capacity in suitable proportions and compacted in the shape and size desired. Powders and tablets preferably contain from one to about seventy percent of the active compound. Suitable carriers are magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. The term "preparation" is intended to include the formulation of the active compound with encapsulating material as carrier providing a capsule in which the active component, with or without carriers, is surrounded by a carrier, which is in association with it. Similarly, cachets and lozenges are included. Tablets, powders, capsules, pills, cachets, and lozenges can be as solid forms suitable for oral administration.

Drops according to the present invention may comprise sterile or non-sterile aqueous or oil solutions or suspensions, and may be prepared by dissolving the active ingredient in a suitable aqueous solution, optionally including a bactericidal and/or fungicidal agent and/or any other suitable preservative, and optionally including a surface active agent. The resulting solution may then be clarified by filtration, transferred to a suitable container which is then sealed and sterilized by autoclaving or maintaining at 98-100° C. for half an hour. Alternatively, the solution may be sterilized by filtration and transferred to the container aseptically. Examples of bactericidal and fungicidal agents suitable for inclusion in the drops are phenylmercuric nitrate or acetate (0.002%), benzalkonium chloride (0.01%) and chlorhexidine acetate (0.01%). Suitable solvents for the preparation of an oily solution include glycerol, diluted alcohol and propylene glycol.

Also included are solid form preparations which are intended to be converted, shortly before use, to liquid form preparations for oral administration. Such liquid forms include solutions, suspensions, and emulsions. These preparations may contain, in addition to the active component, colorants, flavours, stabilizers, buffers, artificial and natural sweeteners, dispersants, thickeners, solubilizing agents, and the like.

Other forms suitable for oral administration include liquid form preparations including emulsions, syrups, elixirs, aqueous solutions, aqueous suspensions, toothpaste, gel dentifrice, chewing gum, or solid form preparations which are intended to be converted shortly before use to liquid form preparations. Emulsions may be prepared in solutions in aqueous propylene glycol solutions or may contain emulsifying agents such as lecithin, sorbitan monooleate, or acacia. Aqueous solutions can be prepared by dissolving the active component in water and adding suitable colorants, flavours, stabilizing and thickening agents. Aqueous suspensions can be prepared by dispersing the finely divided active component in water with viscous material, such as natural or synthetic gums, resins, methylcellulose, sodium carboxymethylcellulose, and other well known suspending agents. Solid form preparations include solutions, suspensions, and emulsions, and may contain, in addition to the active component, colorants, flavours, stabilizers, buffers, artificial and natural sweeteners, dispersants, thickeners, solubilizing agents, and the like.

The compounds of the present invention may be formulated for parenteral administration (e.g., by injection, for example bolus injection or continuous infusion) and may be presented in unit dose form in ampoules, pre-filled syringes, small volume infusion or in multi-dose containers with an added preservative. The compositions may take such forms as suspensions, solutions, or emulsions in oily or aqueous vehicles, for example solutions in aqueous polyethylene glycol. Examples of oily or nonaqueous carriers, diluents, solvents or vehicles include propylene glycol, polyethylene glycol, vegetable oils (e.g., olive oil), and injectable organic esters (e.g., ethyl oleate), and may contain formulatory agents such as preserving, wetting, emulsifying or suspending, stabilizing and/or dispersing agents. Alternatively, the active ingredient may be in powder form, obtained by aseptic isolation of sterile solid or by lyophilisation from solution for constitution before use with a suitable vehicle, e.g., sterile, pyrogen-free water.

Oils useful in parenteral formulations include petroleum, animal, vegetable, or synthetic oils. Specific examples of oils useful in such formulations include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

Suitable soaps for use in parenteral formulations include fatty alkali metal, ammonium, and triethanolamine salts, and suitable detergents include (a) cationic detergents such as, for example, dimethyl dialkyl ammonium halides, and alkyl pyridinium halides; (b) anionic detergents such as, for example, alkyl, aryl, and olefin sulfonates, alkyl, olefin, ether, and monoglyceride sulfates, and sulfosuccinates, (c) nonionic detergents such as, for example, fatty amine oxides, fatty acid alkanolamides, and polyoxyethylenepolypropylene copolymers, (d) amphoteric detergents such as, for example, alkyl-.beta.-aminopropionates, and 2-alkyl-imidazoline quaternary ammonium salts, and (e) mixtures thereof.

The parenteral formulations typically will contain from about 0.5 to about 25% by weight of the active ingredient in solution. Preservatives and buffers may be used. In order to minimize or eliminate irritation at the site of injection, such compositions may contain one or more nonionic surfactants having a hydrophile-lipophile balance (HLB) of from about 12 to about 17. The quantity of surfactant in such formulations will typically range from about 5 to about 15% by weight. Suitable surfactants include polyethylene sorbitan fatty acid esters, such as sorbitan monooleate and the high molecular weight adducts of ethylene oxide with a hydrophobic base, formed by the condensation of propylene oxide with propylene glycol. The parenteral formulations can be presented in unit-dose or multi-dose sealed containers, such as ampules and vials, and can be stored in a freeze-dried (lyophilized) condition requiring only the addition of the sterile liquid excipient, for example, water, for injections, immediately prior to use. Extemporaneous injection solutions and suspensions can be prepared from sterile powders, granules, and tablets of the kind previously described.

The compounds of the invention can also be delivered topically. Regions for topical administration include the skin surface and also mucous membrane tissues of the vagina, rectum, nose, mouth, and throat. Compositions for topical administration via the skin and mucous membranes should not give rise to signs of irritation, such as swelling or redness.

The topical composition may include a pharmaceutically acceptable carrier adapted for topical administration. Thus, the composition may take the form of a suspension, solution, ointment, lotion, sexual lubricant, cream, foam, aerosol, spray, suppository, implant, inhalant, tablet, capsule, dry powder, syrup, balm or lozenge, for example. Methods for preparing such compositions are well known in the pharmaceutical industry.

The compounds of the present invention may be formulated for topical administration to the epidermis as ointments, creams or lotions, or as a transdermal patch. Ointments and creams may, for example, be formulated with an aqueous or oily base with the addition of suitable thickening and/or gelling agents. Lotions may be formulated with an aqueous or oily base and will in general also containing one or more emulsifying agents, stabilizing agents, dispersing agents, suspending agents, thickening agents, or colouring agents. Formulations suitable for topical administration in the mouth include lozenges comprising active agents in a flavoured base, usually sucrose and acacia or tragacanth; pastilles comprising the active ingredient in an inert base such as gelatin and glycerin or sucrose and acacia; and mouthwashes comprising the active ingredient in a suitable liquid carrier.

Creams, ointments or pastes according to the present invention are semi-solid formulations of the active ingredient for external application. They may be made by mixing the active ingredient in finely-divided or powdered form, alone or in solution or suspension in an aqueous or non-aqueous fluid, with the aid of suitable machinery, with a greasy or non-greasy base. The base may comprise hydrocarbons such as hard, soft or liquid paraffin, glycerol, beeswax, a metallic soap; a mucilage; an oil of natural origin such as almond, corn, arachis, castor or olive oil; wool fat or its derivatives or a fatty acid such as steric or oleic acid together with an alcohol such as propylene glycol or a macrogel. The formulation may incorporate any suitable surface active agent such as an anionic, cationic or non-ionic surfactant such as a sorbitan ester or a polyoxyethylene derivative thereof. Suspending agents such as natural gums, cellulose derivatives or inorganic materials such as silicaceous silicas, and other ingredients such as lanolin, may also be included.

Lotions according to the present invention include those suitable for application to the skin or eye. An eye lotion may comprise a sterile aqueous solution optionally containing a bactericide and may be prepared by methods similar to those for the preparation of drops. Lotions or liniments for application to the skin may also include an agent to hasten drying and to cool the skin, such as an alcohol or acetone, and/or a moisturizer such as glycerol or an oil such as castor oil or arachis oil.

Transdermal Delivery

The pharmaceutical agent-chemical modifier complexes described herein can be administered transdermally. Transdermal administration typically involves the delivery of a pharmaceutical agent for percutaneous passage of the drug into the systemic circulation of the patient. The skin sites include anatomic regions for transdermally administering the drug and include the forearm, abdomen, chest, back, buttock, mastoidal area, and the like.

Transdermal delivery is accomplished by exposing a source of the complex to a patient's skin for an extended period of time. Transdermal patches have the added advantage of providing controlled delivery of a pharmaceutical agent-chemical modifier complex to the body. See Transdermal Drug Delivery: Developmental Issues and Research Initiatives, Hadgraft and Guy (eds.), Marcel Dekker, Inc., (1989); Controlled Drug Delivery Fundamentals and Applications, Robinson and Lee (eds.), Marcel Dekker Inc., (1987); and Transdermal Delivery of Drugs, Vols. 1-3, Kydonieus and Berner (eds.), CRC Press, (1987). Such dosage forms can be made by dissolving, dispersing, or otherwise incorporating the pharmaceutical agent-chemical modifier complex in a proper medium, such as an elastomeric matrix material. Absorption enhancers can also be used to increase the flux of the compound across the skin. The rate of such flux can be controlled by either providing a rate-controlling membrane or dispersing the compound in a polymer matrix or gel.

Passive Transdermal Drug Delivery

A variety of types of transdermal patches will find use in the methods described herein. For example, a simple adhesive patch can be prepared from a backing material and an acrylate adhesive. The pharmaceutical agent-chemical modifier complex and any enhancer are formulated into the adhesive casting solution and allowed to mix thoroughly. The solution is cast directly onto the backing material and the casting solvent is evaporated in an oven, leaving an adhesive film. The release liner can be attached to complete the system.

Alternatively, a polyurethane matrix patch can be employed to deliver the pharmaceutical agent-chemical modifier complex. The layers of this patch comprise a backing, a polyurethane drug/enhancer matrix, a membrane, an adhesive, and a release liner. The polyurethane matrix is prepared using a room temperature curing polyurethane prepolymer. Addition of water, alcohol, and complex to the prepolymer results in the formation of a tacky firm elastomer that can be directly cast only the backing material.

A further embodiment of this invention will utilize a hydrogel matrix patch. Typically, the hydrogel matrix will comprise alcohol, water, drug, and several hydrophilic polymers. This hydrogel matrix can be incorporated into a transdermal patch between the backing and the adhesive layer.

The liquid reservoir patch will also find use in the methods described herein. This patch comprises an impermeable or semipermeable, heat sealable backing material, a heat sealable membrane, an acrylate based pressure sensitive skin adhesive, and a siliconized release liner. The backing is heat sealed to the membrane to form a reservoir which can then be filled with a solution of the complex, enhancers, gelling agent, and other excipients.

Foam matrix patches are similar in design and components to the liquid reservoir system, except that the gelled pharmaceutical agent-chemical modifier solution is constrained in a thin foam layer, typically a polyurethane. This foam layer is situated between the backing and the membrane which have been heat sealed at the periphery of the patch.

For passive delivery systems, the rate of release is typically controlled by a membrane placed between the reservoir and the skin, by diffusion from a monolithic device, or by the skin itself serving as a rate-controlling barrier in the delivery system. See U.S. Pat. Nos. 4,816,258; 4,927,408; 4,904,475; 4,588,580, 4,788,062; and the like. The rate of drug delivery will be dependent, in part, upon the nature of the membrane. For example, the rate of drug delivery across membranes within the body is generally higher than across dermal barriers. The rate at which the complex is delivered from the device to the membrane is most advantageously controlled by the use of rate-limiting membranes which are placed between the reservoir and the skin. Assuming that the skin is sufficiently permeable to the complex (i.e., absorption through the skin is greater than the rate of passage through the membrane), the membrane will serve to control the dosage rate experienced by the patient.

Suitable permeable membrane materials may be selected based on the desired degree of permeability, the nature of the complex, and the mechanical considerations related to constructing the device. Exemplary permeable membrane materials include a wide variety of natural and synthetic polymers, such as polydimethylsiloxanes (silicone rubbers), ethylenevinylacetate copolymer (EVA), polyurethanes, polyurethane-polyether copolymers, polyethylenes, polyamides, polyvinylchlorides (PVC), polypropylenes, polycarbonates, polytetrafluoroethylenes (PTFE), cellulosic materials, e.g., cellulose triacetate and cellulose nitrate/acetate, and hydrogels, e.g., 2-hydroxyethylmethacrylate (HEMA).

Other items may be contained in the device, such as other conventional components of therapeutic products, depending upon the desired device characteristics. For example, the compositions according to this invention may also include one or more preservatives or bacteriostatic agents, e.g., methyl hydroxybenzoate, propyl hydroxybenzoate, chlorocresol, benzalkonium chlorides, and the like. These pharmaceutical compositions also can contain other active ingredients such as antimicrobial agents, particularly antibiotics, anesthetics, analgesics, and antipruritic agents.

The compounds of the present invention may be formulated for administration as suppositories. A low melting wax, such as a mixture of fatty acid glycerides or cocoa butter is first melted and the active component is dispersed homogeneously, for example, by stirring. The molten homogeneous mixture is then poured into convenient sized molds, allowed to cool, and to solidify.

The active compound may be formulated into a suppository comprising, for example, about 0.5% to about 50% of a compound of the invention, disposed in a polyethylene glycol (PEG) carrier (e.g., PEG 1000 [96%] and PEG 4000 [4%].

The compounds of the present invention may be formulated for vaginal administration. Pessaries, tampons, creams, gels, pastes, foams or sprays containing in addition to the active ingredient such carriers as are known in the art to be appropriate.

The compounds of the present invention may be formulated for nasal administration. The solutions or suspensions are applied directly to the nasal cavity by conventional means, for example with a dropper, pipette or spray. The formulations may be provided in a single or multidose form. In the latter case of a dropper or pipette this may be achieved by the patient administering an appropriate, predetermined volume of the solution or suspension. In the case of a spray this may be achieved for example by means of a metering atomizing spray pump.

The compounds of the present invention may be formulated for aerosol administration, particularly to the respiratory tract and including intranasal administration. The compound will generally have a small particle size for example of the order of 5 microns or less. Such a particle size may be obtained by means known in the art, for example by micronization. The active ingredient is provided in a pressurized pack with a suitable propellant such as a chlorofluorocarbon (CFC) for example dichlorodifluoromethane, trichlorofluoromethane, or dichlorotetrafluoroethane, carbon dioxide or other suitable gas. The aerosol may conveniently also contain a surfactant such as lecithin. The dose of drug may be controlled by a metered valve. Alternatively the active ingredients may be provided in a form of a dry powder, for example a powder mix of the compound in a suitable powder base such as lactose, starch, starch derivatives such as hydroxypropylmethyl cellulose and polyvinylpyrrolidine (PVP). The powder carrier will form a gel in the nasal cavity. The powder composition may be presented in unit dose form for example in capsules or cartridges of e.g., gelatin or blister packs from which the powder may be administered by means of an inhaler.

When desired, formulations can be prepared with enteric coatings adapted for sustained or controlled release administration of the active ingredient.

The pharmaceutical preparations are preferably in unit dosage forms. In such form, the preparation is subdivided into unit doses containing appropriate quantities of the active component. The unit dosage form can be a packaged preparation, the package containing discrete quantities of preparation, such as packeted tablets, capsules, and powders in vials or ampoules. Also, the unit dosage form can be a capsule, tablet, cachet, or lozenge itself, or it can be the appropriate number of any of these in packaged form.

Pharmaceutically Acceptable Salts

Pharmaceutically acceptable salts of the instant compounds, where they can be prepared, are also intended to be covered by this invention. These salts will be ones which are acceptable in their application to a pharmaceutical use. By that it is meant that the salt will retain the biological activity of the parent compound and the salt will not have untoward or deleterious effects in its application and use in treating diseases.

Pharmaceutically acceptable salts are prepared in a standard manner. If the parent compound is a base it is treated with an excess of an organic or inorganic acid in a suitable solvent. If the parent compound is an acid, it is treated with an inorganic or organic base in a suitable solvent.

The compounds of the invention may be administered in the form of an alkali metal or earth alkali metal salt thereof, concurrently, simultaneously, or together with a pharmaceutically acceptable carrier or diluent, especially and preferably in the form of a pharmaceutical composition thereof, whether by oral, rectal, or parenteral (including subcutaneous) route, in an effective amount.

Examples of pharmaceutically acceptable acid addition salts for use in the present inventive pharmaceutical composition include those derived from mineral acids, such as hydrochloric, hydrobromic, phosphoric, metaphosphoric, nitric and sulfuric acids, and organic acids, such as tartaric, acetic, citric, malic, lactic, fumaric, benzoic, glycolic, gluconic, succinic, p-toluenesulphonic acids, and arylsulphonic, for example.

Therapeutically useful agents can be formulated into a composition with the antibodies of the invention and need not be directly attached to the antibodies of the invention. However, in some embodiments, therapeutically useful agents are attached to the antibodies of the invention using methods available to one of skill in the art, for example, standard coupling procedures.

Compositions may contain antibodies, antigenic epitopes or trypsin-like protease inhibitors. Such compositions are useful for detecting the antigenic peptide epitopes (glycopeptides) and for therapeutic methods involving prevention and treatment of cancers associated with the presence of said antigenic epitopes.

The antibodies, (and for example antigenic epitopes and protease inhibitors) can be formulated as pharmaceutical compositions and administered to a mammalian host, such as a human patient in a variety of forms adapted to the chosen route of administration. Routes for administration include, for example, intravenous, intra-arterial, subcutaneous, intramuscular, intraperitoneal and other routes selected by one of skill in the art.

Solutions of the antibodies, (and for example antigenic epitopes and protease inhibitors) can be prepared in water or saline, and optionally mixed with a nontoxic surfactant. Formulations for intravenous or intra-arterial administration may include sterile aqueous solutions that may also contain buffers, liposomes, diluents and other suitable additives.

The pharmaceutical dosage forms suitable for injection or infusion can include sterile aqueous solutions or dispersions comprising the active ingredient that are adapted for administration by encapsulation in liposomes. In all cases, the ultimate dosage form must be sterile, fluid and stable under the conditions of manufacture and storage.

Sterile injectable solutions are prepared by incorporating the antibodies, antigenic epitopes and protease inhibitors in the required amount in the appropriate solvent with various of the other ingredients enumerated above, as required, followed by filter sterilization.

In one aspect the present invention relates to a pharmaceutical composition comprising an active ingredient, wherein said active ingredient is selected from (i) one or more of the O-glycosylated peptides defined herein above, or (ii) the antibody capable of recognising the peptide of (i), or any other antibody defined herein above, and wherein the pharmaceutical composition further comprises a pharmaceutically acceptable carrier or diluent.

In one embodiment the pharmaceutical composition is formulated for administration by injection, suppository, oral administration, sublingual tablet or spray, cutaneous administration or inhalation.

In one embodiment said injection is intramuscular, intravenous, intranasal, intraperitoneal, subcutaneous, a bolus or a continuous administration.

In one embodiment the pH of the pharmaceutical composition is between pH 4 and pH 10.

In one embodiment administration of the pharmaceutical composition occurs at intervals of 30 minutes to 24 hours.

In one embodiment administration of the pharmaceutical composition occurs at intervals of 1 to 6 hours.

In one embodiment the duration of the treatment with the pharmaceutical composition is from 6 to 72 hours.

In one embodiment the duration of the treatment with the pharmaceutical composition is life long.

In one embodiment the dosage of the active ingredient is between 10 µg to 500 mg per kg body mass.

Diagnostic Kits

Kits for detection of the antigenic peptide epitopes of the present invention can be provided.

A kit for detection of the antigenic epitope of the invention may contain a container containing an antibody capable of binding to an antigenic epitope of the invention. Such an antibody may be labeled for easy detection. Individual kits may be adapted for performing one or more of the methods of the invention. Optionally, the subject kit may further comprise at least one other reagent required for performing the method that the kit is adapted to perform. Examples of such additional reagents include: a label, a standard, a control, a buffer, a solution for diluting the test sample, or a reagent that facilitates detection of the label. The reagents included in the kits of the invention may be supplied in premeasured units so as to provide for greater precision and accuracy. Typically, kits reagents and other components are placed and contained in separate vessels. A reaction vessel, test tube, microwell tray, microtiter dish or other container can also be included in the kit. Different labels can be used on different reagents so that each reagent can be distinguished from another.

The kit can also be for the treatment of cancer comprising a pharmaceutical composition and an instructional material. Such a kit may contain a container having an antigenic epitope, an antibody or an inhibitor of the invention. The antigenic epitope may act as a vaccine for preventing formation of metastatic adenocarcinoma. The antibody is directed against an antigenic epitope of the invention and can be administered to treat or prevent the spread of adenocarcinomas. Any one of these antigenic epitopes, antibodies or inhibitors may be contained within an appropriate container in the kit. Alternatively, a combination of antigenic epitopes, antibodies or inhibitors may be contained within an appropriate container in the kit.

Further, a kit comprising a pharmaceutical composition and a delivery device for delivering the composition to a mammal, for example, a human patient who may have an adenocarcinoma can also be provided. By way of example, the delivery device may be a squeezable spray bottle, a metered-dose spray bottle, an aerosol spray device, an atomizer, a dry powder delivery device, a self-propelling solvent/powder-dispensing device, a syringe, a needle, a tampon, or a dosage measuring container.

In one aspect, the present invention relates to a method for identifying a disease (e.g. cancer such as colorectal cancer) associated with shedding of O-glycosylated peptides or peptide fragments, said method comprising the steps of:
(i) selecting potential target polypeptides containing potential O-glycosylation sites, and
(ii) producing recombinant fragments covering specific areas of interest from each potential target, and/or
(iii) producing synthetic peptides covering specific areas of interest from each potential target, and
(iv) in vitro glycosylate the fragments of (ii) and/or (iii) using recombinant glycosyltransferases
(v) purifying the fragments of (iv), and
(vi) characterizing the purified products of (v), and
(vii) printing of non-glycosylated and glycosylated targets,
(viii) screening the printed targets of (vii) with sera from a potentially diseased sample host and
(ix) screening the printed targets of (vii) with sera from a healthy sample host as control, wherein the presence of auto-antibodies bound to the printed targets of (viii) indicates disease in the potentially diseased sample host.

In one embodiment of the method for identifying a disease defined herein above, the recombinant fragments covering specific areas of interest from each potential target are between 10 to 30 kDa.

In one embodiment of the method for identifying a disease defined herein above, the synthetic fragments covering specific areas of interest from each potential target are between 10 and 30 amino acid residues.

In one embodiment of the method for identifying a disease defined herein above, the purification is by HPLC.

In one embodiment of the method for identifying a disease defined herein above, the characterization of the glycosylation products is by MALDI-TOF.

In one embodiment the kit of the invention comprises items useful in the method defined herein above.

Device

The glycopeptides of the invention have been used to construct a device for detecting disease, in particular cancer and especially colorectal cancer. One way of constructing the device is the Mucin O-glycopeptide array print method demonstrated in example 2. Thus, in one aspect the method defined herein, wherein the at least two, or the one or more O-glycosylated peptides are conjugated to a surface form a glycopeptide array device discussed above.

In one aspect the invention is directed to a device comprising at least two different O-glycosylated peptides conjugated to a surface, wherein the at least two different peptides are selected from the peptides defined herein above.

In an analogous embodiment the method is reversed such that the antibodies defined herein above are conjugated to a surface thus forming an antibody array device of the present invention.

In one such embodiment the invention relates to a device comprising a plurality of different antibodies conjugated to a surface, wherein one or more of the antibodies is/are selected from the antibodies defined herein above In a further embodiment the invention relates to the use of the device defined herein above.

In another aspect, the present invention relates to a device comprising a plurality of glycosylated peptides attached to a surface, wherein at least a part of the peptides are selected from the peptides defined herein above.

As discussed above, the glycopeptides and the antibodies of the invention act in a lock-and-key manner. Thus, in one aspect, the present invention relates to a device comprising a plurality of antibodies covalently attached to a surface, wherein at least a part of the antibodies are selected from the antibodies as defined herein, i.e. including but not limited to the antibodies selected from the group consisting of MAb 5C10, MAb 3C9, MAb 4D9, MAb 6C11 and MAb 6E3.

In one aspect, the present invention relates to a mucin peptide as defined herein above for use as a medicament, in particular for use in a method of treatment of cancer. Said mucin peptide used in said method of treatment of cancer can e.g. include immunisation of an individual by administering to said individual the glycosylated mucin peptide. The medical use also applies to the other part of the lock-and-key invention. Thus, in this aspect the present invention relates to a method of immunising an individual, by administering to said individual an antibody of the invention In one aspect, the present invention relates to a device comprising a plurality of glycosylated peptides attached to a surface, wherein at least a part of the peptides are selected from the peptides defined herein above.

In a further aspect, the present invention relates to a device comprising a plurality of antibodies covalently attached to a surface, wherein at least a part of the antibodies are selected from the antibodies defined herein above.

In a further embodiment, the device comprises a mixture of glycosylated peptides and antibodies according to the present invention, and may thus be used as a multi-detection tool.

In one aspect the invention relates to a device comprising a plurality of glycosylated peptides conjugated to a surface, wherein at least a part of the peptides are selected from the peptides defined herein above.

In one aspect the invention relates to a device comprising a plurality of antibodies conjugated to a surface, wherein at least a part of the antibodies are selected from the antibodies defined herein above.

In one aspect the present invention relates to the use of the device defined herein above, in a method of identifying auto-antibodies associated with disease, said method comprising contacting said device with a sample from a host organism.

In one aspect the present invention relates to the use of the device defined herein above in a method of identifying O-glycosylated peptides associated with disease, said method comprising contacting said device with a sample from a host organism.

In one embodiment the disease identifiable using said device is cancer, wherein the cancer is selected from the group consisting of colorectal cancer, breast cancer, oral cancer, gastric cancer, esophageal cancer, pancreatic cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

In one embodiment the disease identifiable using said device is colorectal cancer.

Methods of Treating Cancer

Passive Immunisation

Passive immunity is the transfer of active humoral immunity in the form of readymade antibodies, such as the antibodies of the present invention. Passive immunity can occur naturally, when maternal antibodies are transferred to the fetus through the placenta, and can also be induced artificially, when high levels of human antibodies specific for e.g. an O-glycosylated mucin peptide of the invention is transferred to non-immune individuals.

One method of treating cancer, such as colorectal cancer is passive immunisation.

In one aspect the antibody defined herein can be used in a method of treatment of cancer comprising passive immunisation. The cancer is selected from the group consisting of colorectal cancer, breast cancer, oral cancer, gastric cancer, esophageal cancer, pancreatic cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

In one embodiment, one or more antibodies of the invention have been conjugated to one or more toxins capable of destroying the cells such as cancer cells.

A toxin is understood as an agent having cytotoxic properties. A toxin may be e.g. a biotoxin such as a toxin produced by microorganisms or a protein isolated from the venom of the cone snail, spider, snake, scorpion, jellyfish, wasp, bee, ant, termite, honeybee, wasp, poison dart frog.

In one embodiment the toxin is selected from the group consisting of cyanotoxins, hemotoxins, necrotoxins, cytotoxins such as but not limited to ricin and apitoxin.

In one embodiment the toxin conjugated to the antibody of the invention is selected from the group consisting of small molecules, metals, metal ions, small inorganic molecules, proteins, peptides, glycopeptides, RNA, DNA and siRNA.

In one embodiment the toxin conjugated to the antibody of the invention is a venom from spider, snake, scorpion, jellyfish, wasp, bee, ant, termite, honeybee, wasp or poison dart frog.

In one embodiment the toxin conjugated to the antibody of the invention is selected from the group consisting of cyanotoxin, hemotoxin, necrotoxin and cytotoxin.

In one embodiment a toxin has been conjugated to the antibody of the invention as defined herein above.

In one embodiment the toxin-conjugated antibodies of the invention are administered to a patient afflicted with disease, such as cancer.

In one embodiment, the combination of toxins is such that individually they are not potent cell killers, but when presented simultaneously to an individual cell their combined effects are lethal to that cell.

In one embodiment the toxin conjugated antibody of the invention targets a cancer cell that presents a matching O-glycosylated mucin peptide epitope on the cell surface, resulting in that the conjugated toxin can act to destroy the cancer cell presenting the O-glycosylated mucin peptide epitope on the cell surface. In a further embodiment of the invention, one or more antibodies capable of recognising different O-glycosylated mucin targets presented by cells of a particular cancer are administered to the patient; these antibodies can similarly be conjugated to one or more toxins capably of destroying the cancer cells. In a particular embodiment, the combination of toxins is such that individually they are not potent cell killers, but when presented simultaneously to an individual cell their combined effects are lethal to that cell.

In a further aspect, the present invention relates to a method of passively immunising an individual, said method comprising administering to said individual an antibody as defined herein above.

Active Immunisation

In one aspect, also the glycosylated mucin peptides as defined herein above may be used as a medicament e.g. in a method of treatment of cancer, wherein the cancer is selected from the group consisting of colorectal cancer, breast cancer, oral cancer, gastric cancer, esophageal cancer, pancreatic cancer, cholangiocarcinoma, ovarian cancer, lung cancer, renal cancer, prostate cancer, hepatocellular carcinoma, testis cancer, basal cell cancer, squamous cell cancer, malignant melanoma, bladder cancer, endometrial cancer and cervix cancer.

In one aspect, the present invention relates to a method of actively immunizing an individual, said method comprising administering to said individual a glycosylated mucin peptide as defined herein above.

REFERENCES

Ahlquist, D. A., D. J. Sargent, et al. (2008). "Stool DNA and occult blood testing for screen detection of colorectal neoplasia." *Ann Intern Med* 149(7): 441-50, W81.

Anderson, K. S, and J. LaBaer (2005). "The sentinel within: exploiting the immune system for cancer biomarkers." *J Proteome Res* 4(4): 1123-33.

Baseler, M. W., P. E. Maxim, et al. (1987). "Circulating IgA immune complexes in head and neck cancer, nasopharyngeal carcinoma, lung cancer, and colon cancer." *Cancer* 59(10): 1727-31.

Chen, Y. T., M. J. Scanlan, et al. (1997). "A testicular antigen aberrantly expressed in human cancers detected by autologous antibody screening." *Proc Natl Acad Sci USA* 94(5): 1914-8.

Etzioni, R., N. Urban, et al. (2003). "The case for early detection." *Nat Rev Cancer* 3(4): 243-52.

Garcea, G., R. A. Sharma, et al. (2003). "Molecular biomarkers of colorectal carcinogenesis and their role in surveillance and early intervention." *Eur J Cancer* 39(8): 1041-52.

Gebauer, G., W. Jager, et al. (1998). "mRNA expression of components of the insulin-like growth factor system in breast cancer cell lines, tissues, and metastatic breast cancer cells." *Anticancer Res* 18(2A): 1191-5.

Hakomori, S. (2001). "Tumor-associated carbohydrate antigens defining tumor malignancy: basis for development of anti-cancer vaccines." *Adv Exp Med Biol* 491: 369-402.

Hakomori, S. (2002). "Glycosylation defining cancer malignancy: new wine in an old bottle." *Proc Natl Acad Sci USA* 99(16): 10231-3.

Hospital, V. (2006). "Cancer Facts and Figures." *American Cancer Society, Atalanta*

Hsiung, P. L., J. Hardy, et al. (2008). "Detection of colonic dysplasia in vivo using a targeted heptapeptide and confocal microendoscopy." *Nat Med* 14(4): 454-8.

Itzkowitz, S. H., E. J. Bloom, et al. (1990). "Sialosyl-Tn. A novel mucin antigen associated with prognosis in colorectal cancer patients." *Cancer* 66(9): 1960-6.

Iwai, T., T. Kudo, et al. (2005). "Core 3 synthase is downregulated in colon carcinoma and profoundly suppresses the metastatic potential of carcinoma cells." *Proc Natl Acad Sci USA* 102(12): 4572-7.

Jager, E., E. Stockert, et al. (1999). "Humoral immune responses of cancer patients against "Cancer-Testis" antigen NY-ESO-1: correlation with clinical events." *Int J Cancer* 84(5): 506-10.

Jemal, A., T. Murray, et al. (2005). "Cancer statistics, 2005." *CA Cancer J Clin* 55(1): 10-30.

Jonckheere, N., M. Perrais, et al. (2004). "A role for human MUC4 mucin gene, the ErbB2 ligand, as a target of TGF-beta in pancreatic carcinogenesis." *Oncogene* 23(34): 5729-38.

Ju, T., G. S. Lanneau, et al. (2008). "Human tumor antigens Tn and sialyl Tn arise from mutations in Cosmc." *Cancer Res* 68(6): 1636-46.

Kaetzel, C. S. (2005). "The polymeric immunoglobulin receptor: bridging innate and adaptive immune responses at mucosal surfaces." *Immunol Rev* 206: 83-99.

Kim, H. J., M. H. Yu, et al. (2008). "Noninvasive molecular biomarkers for the detection of colorectal cancer." *BMB Rep* 41(10): 685-92.

Liu, W. L., G. Zhang, et al. (2008). "Proteomics-based identification of autoantibody against CDC25B as a novel serum marker in esophageal squamous cell carcinoma." *Biochem Biophys Res Commun* 375(3): 440-5.

Mintz, P. J., J. Kim, et al. (2003). "Fingerprinting the circulating repertoire of antibodies from cancer patients." *Nat Biotechnol* 21(1): 57-63.

Mirgorodskaya, E., H. Hassan, et al. (1999). "Partial vapor-phase hydrolysis of peptide bonds: A method for mass spectrometric determination of O-glycosylated sites in glycopeptides." *Anal Biochem* 269(1): 54-65.

Nakamori, S., D. M. Ota, et al. (1994). "MUC1 mucin expression as a marker of progression and metastasis of human colorectal carcinoma." *Gastroenterology* 106(2): 353-61.

Napoletano, C., A. Rughetti, et al. (2007). "Tumor-associated Tn-MUC1 glycoform is internalized through the macrophage galactose-type C-type lectin and delivered to the HLA class I and II compartments in dendritic cells." *Cancer Res* 67(17): 8358-67.

Napoletano, C., A. Rughetti, et al. (2007). "Tumor-associated Tn-MUC1 glycoform is internalized through the macrophage galactose-type C-type lectin and delivered to the HLA class I and II compartments in dendritic cells." *Cancer Res.* 67(17): 8358-8367.

Nolen, B., M. Winans, et al. (2009). "Aberrant tumor-associated antigen autoantibody profiles in healthy controls detected by multiplex bead-based immunoassay." *J Immunol Methods* 344(2): 116-20.

Ogata, S., I. Ho, et al. (1995). "Tumor-associated sialylated antigens are constitutively expressed in normal human colonic mucosa." *Cancer Res* 55(9): 1869-74.

Pandey, J. P., Y. Luo, et al. (2008). "Immunoglobulin allotypes influence IgG antibody responses to hepatitis C virus envelope proteins E1 and E2." *Hum Immunol* 69(3): 158-64.

Pereira-Faca, S. R., R. Kuick, et al. (2007). "Identification of 14-3-3 theta as an antigen that induces a humoral response in lung cancer." *Cancer Res* 67(24): 12000-6.

Sabbatini, P. J., G. Ragupathi, et al. (2007). "Pilot study of a heptavalent vaccine-keyhole limpet hemocyanin conjugate plus QS21 in patients with epithelial ovarian, fallopian tube, or peritoneal cancer." *Clin Cancer Res* 13(14): 4170-7.

Scanlan, M. J., Y. T. Chen, et al. (1998). "Characterization of human colon cancer antigens regognised by autologous antibodies." *Int J Cancer* 76(5): 652-8.

Scian, M. J., E. H. Carchman, et al. (2008). "Wild-type p53 and p73 negatively regulate expression of proliferation related genes." *Oncogene* 27(18): 2583-93.

Selby, J. V., G. D. Friedman, et al. (1992). "A case-control study of screening sigmoidoscopy and mortality from colorectal cancer." *N Engl J Med* 326(10): 653-7.

Sorensen, A. L., C. A. Reis, et al. (2006). "Chemoenzymatically synthesized multimeric Tn/STn MUC1 glycopeptides elicit cancer-specific anti-MUC1 antibody responses and override tolerance." *Glycobiology* 16(2): 96-107.

Springer, G. F. (1984). "T and Tn, general carcinoma autoantigens." *Science* 224(4654): 1198-1206.

Stockert, E., E. Jager, et al. (1998). "A survey of the humoral immune response of cancer patients to a panel of human tumor antigens." *J Exp Med* 187(8): 1349-54.

Sugita, Y., H. Wada, et al. (2004). "NY-ESO-1 expression and immunogenicity in malignant and benign breast tumors." *Cancer Res* 64(6): 2199-204.

Svane, I. M., A. E. Pedersen, et al. (2004). "Vaccination with p53-peptide-pulsed dendritic cells, of patients with advanced breast cancer: report from a phase I study." *Cancer Immunol Immunother* 53(7): 633-41.

Tarp, M. A., A. L. Sorensen, et al. (2007). "Identification of a novel cancer-specific immunodominant glycopeptide epitope in the MUC1 tandem repeat."*Glycobiology* 17(2): 197-209.

Tinder, T. L., D. B. Subramani, et al. (2008). "MUC1 enhances tumor progression and contributes toward immunosuppression in a mouse model of spontaneous pancreatic adenocarcinoma." *J Immunol* 181(5): 3116-25.

van Kooyk, Y. (2008). "C-type lectins on dendritic cells: key modulators for the induction of immune responses." *Biochem Soc Trans* 36(Pt 6): 1478-81.

van Vliet, S. J., L. E. van, et al. (2005). "Carbohydrate profiling reveals a distinctive role for the C-type lectin MGL in the recognition of helminth parasites and tumor antigens by dendritic cells." *Int. Immunol.* 17(5): 661-669.

Vogelstein, B., E. R. Fearon, et al. (1988). "Genetic alterations during colorectal-tumor development." *N End J Med* 319(9): 525-32.

von Mensdorff-Pouilly, S., E. Petrakou, et al. (2000). "Reactivity of natural and induced human antibodies to MUC1 mucin with MUC1 peptides and n-acetylgalactosamine (GalNAc) peptides." *Int J Cancer* 86(5): 702-12.

Wandall, H. H., F. Irazoqui, et al. (2007). "The lectin domains of polypeptide GalNAc-transferases exhibit carbohydrate-binding specificity for GalNAc: lectin binding to GalNAc-glycopeptide substrates is required for high density GalNAc-β-glycosylation." *Glycobiology* 17(4): 374-387.

Wandall, H. H. T. M. (2009). *Carbohydrate-based Vaccines.*

Wandall, H. H., O. B., Mads A. Tarp, Johannes W. Pedersen, Eric P. Bennett, Ulla Mandel, Govind Ragupathi, Phil Livingston, Michael A. Hollingsworth, Joyce Taylor-Papadimitriou, Joy Burchell, Henrik Clausen (2009). "Autoantibody signatures to aberrant O-glycopeptide epitopes serve as undiscovered biomarkers of cancer" *Submitted.*

Whitlock, E. P., J. S. Lin, et al. (2008). "Screening for colorectal cancer: a targeted, updated systematic review for the U.S. Preventive Services Task Force." *Ann Intern Med* 149(9): 638-58.

Zhang, S., L. A. Walberg, et al. (1995). "Immune sera and monoclonal antibodies define two configurations for the sialyl Tn tumor antigen." *Cancer Res* 55(15): 3364-8.

EXAMPLES

Example 1

Sequences of the Invention

```
Overview of sequences

MUC4                                                        SEQ ID NO: 1

MUC1                                                        SEQ ID NO: 2

MUC4 peptide                                                SEQ ID NO: 3

MUC4 peptide                                                SEQ ID NO: 4

MUC4 peptide                                                SEQ ID NO: 5

MUC4 peptide                                                SEQ ID NO: 6

MUC4 peptide                                                SEQ ID NO: 7

MUC4 peptide                                                SEQ ID NO: 8

MUC4 peptide                                                SEQ ID NO: 9

MUC4 peptide                                                SEQ ID NO: 10

MUC4 peptide                                                SEQ ID NO: 11

MUC4 peptide                                                SEQ ID NO: 12

MUC4 peptide                                                SEQ ID NO: 13

MUC4 peptide                                                SEQ ID NO: 14

MUC4 peptide                                                SEQ ID NO: 15

MUC4 peptide                                                SEQ ID NO: 16

MUC4 peptide                                                SEQ ID NO: 17

MUC4 peptide                                                SEQ ID NO: 18
```

-continued

| | |
|---|---|
| MUC4 peptide | SEQ ID NO: 19 |
| MUC4 peptide | SEQ ID NO: 20 |
| MUC4 peptide | SEQ ID NO: 21 |
| MUC4 peptide | SEQ ID NO: 22 |
| MUC4 peptide | SEQ ID NO: 23 |
| MUC1 peptide | SEQ ID NO: 24 |
| MUC2 peptide | SEQ ID NO: 25 |
| MUC2 | SEQ ID NO: 26 |
| MUC5AC | SEQ ID NO: 27 |
| MUC6 | SEQ ID NO: 28 |
| MUC7 | SEQ ID NO: 29 |
| recMUC4 peptide | SEQ ID NO: 30 |
| recMUC1 peptide | SEQ ID NO: 31 |
| recMUC2 peptide | SEQ ID NO: 32 |
| recMUC5AC peptide | SEQ ID NO: 33 |
| recMUC6 peptide | SEQ ID NO: 34 |
| recMUC7 peptide | SEQ ID NO: 35 |
| MUC3 | SEQ ID NO: 36 |
| MUC3B | SEQ ID NO: 37 |
| MUC5B | SEQ ID NO: 38 |
| MUC8 | SEQ ID NO: 39 |
| MUC12 | SEQ ID NO: 40 |
| MUC13 | SEQ ID NO: 41 |
| MUC14 | SEQ ID NO: 42 |
| MUC15 | SEQ ID NO: 43 |
| MUC16 | SEQ ID NO: 44 |
| MUC17 | SEQ ID NO: 45 |

-continued

| | |
|---|---|
| MUC19 | SEQ ID NO: 46 |
| MUC20 | SEQ ID NO: 47 |
| MUC 21 | SEQ ID NO: 48 |
| MUC HEG | SEQ ID NO: 49 |
| MUC9 | SEQ ID NO: 50 |
| MUC18 | SEQ ID NO: 51 |
| p53 peptide | SEQ ID NO: 52 |
| p53 peptide | SEQ ID NO: 53 |
| p53 peptide | SEQ ID NO: 54 |
| p53 peptide | SEQ ID NO: 55 |
| p53 peptide | SEQ ID NO: 56 |
| p53 peptide | SEQ ID NO: 57 |
| p53 peptide | SEQ ID NO: 58 |
| p53 peptide | SEQ ID NO: 59 |
| p53 peptide | SEQ ID NO: 60 |
| p53 peptide | SEQ ID NO: 61 |
| p53 peptide | SEQ ID NO: 62 |
| p53 peptide | SEQ ID NO: 63 |
| p53 peptide | SEQ ID NO: 64 |
| p53 peptide | SEQ ID NO: 65 |
| p53 peptide | SEQ ID NO: 66 |
| p53 peptide | SEQ ID NO: 67 |
| p53 peptide | SEQ ID NO: 68 |
| p53 peptide | SEQ ID NO: 69 |

Sequence list
(MUC4; human)

SEQ ID NO: 1
>sp|Q99102|MUC4_HUMAN Mucin-4 OS = Homo sapiens GN = MUC4 PE = 1 SV = 2
MKGARWRRVPWVSLSCLCLCLLPHVVPGTTEDTLITGSKTPAPVTSTGSTTATLEGQSTAASSRTSNQDIS

ASSQNHQTKSTETTSKAQTDTLTQMMTSTLFSSPSVHNVMETVTQETAPPDEMTTSFPSSVTNTLMMTSK

```
TITMTTSTDSTLGNTEETSTAGTESSTPVTSAVSITAGQEGQSRTTSWRTSIQDTSASSQNHWTRSTQTTR

ESQTSTLTHRTTSTPSFSPSVHNVTGTVSQKTSPSGETATSSLCSVTNTSMMTSEKITVTTSTGSTLGNPG

ETSSVPVTGSLMPVTSAALVTVDPEGQSPATFSRTSTQDTTAFSKNHQTQSVETTRVSQINTLNTLTPVTT

STVLSSPSGFNPSGTVSQETFPSGETTISSPSSVSNTFLVTSKVFRMPISRDSTLGNTEETSLSVSGTISAIT

SKVSTIWWSDTLSTALSPSSLPPKISTAFHTQQSEGAETTGRPHERSSFSPGVSQEIFTLHETTTVVPSSFS

SKGHTTWSQTELPSTSTGAATRLVTGNPSTRAAGTIPRVPSKVSAIGEPGEPTTYSSHSTTLPKTTGAGAQ

TQWTQETGTTGEALLSSPSYSVIQMIKTATSPSSSPMLDRHTSQQITTAPSTNHSTIHSTSTSPQESPAVS

QRGHTRAPQTTQESQTTRSVSPMTDTKTVTTPGSSFTASGHSPSEIVPQDAPTISAATTFAPAPTGNGHT

TQAPTTALQAAPSSHDATLGPSGGTSLSKTGALTLANSVVSTPGGPEGQWTSASASTSPDTAAAMTHTH

QAESTEASGQTQTSEPASSGSRTTSAGTATPSSSGASGTTPSGSEGISTSGETTRFSSNPSRDSHTTQST

TELLSASASHGAIPVSTGMASSIVPGTFHPTLSEASTAGRPTGQSSPTSPSASPQETAAISRMAQTQRTGT

SRGSDTISLASQATDTFSTVPPTPPSITSSGLTSPQTQTHTLSPSGSGKTFTTALISNATPLPVTSTSSASTG

HATPLAVSSATSASTVSSDSPLKMETSGMTTPSLKTDGGRRTATSPPPTTSQTIISTIPSTAMHTRSTAAPIP

ILPERGVSLFPYGADAGDLEFVRRTVDFTSPLFKPATGFPLGSSLRDSLYFTDNGQIIFPESDYQIFSYPNPL

PTGFTGRDPVALVAPFWDDADFSTGRGTTFYQEYETFYGEHSLLVQQAESWIRKITNNGGYKARWALKV

TWVNAHAYPAQWTLGSNTYQAILSTDGSRSYALFLYQSGGMQWDVAQRSGNPVLMGFSSGDGYFENSP

LMSQPVWERYRPDRFLNSNSGLQGLQFYRLHREERPNYRLECLQWLKSQPRWPSWGWNQVSCPCSW

QQGRRDLRFQPVSIGRWGLGSRQLCSFTSWRGGVCCSYGPWGEFREGWHVQRPWQLAQELEPQSWC

CRWNDKPYLCALYQQRRPHVGCATYRPPQPAWMFGDPHITTLDGVSYTFNGLGDFLLVGAQDGNSSFLL

QGRTAQTGSAQATNFIAFAAQYRSSSLGPVTVQWLLEPHDAIRVLLDNQTVTFQPDHEDGGGQETFNAT

GVLLSRNGSEVSASFDGWATVSVIALSNILHASASLPPEYQNRTEGLLGVWNNNPEDDFRMPNGSTIPPG

SPEEMLFHFGMTWQINGTGLLGKRNDQLPSNFTPVFYSQLQKNSSWAEHLISNCDGDSSCIYDTLALRNA

SIGLHTREVSKNYEQANATLNQYPPSINGGRVIEAYKGQTTLIQYTSNAEDANFTLRDSCTDLELFENGTLL

WTPKSLEPFTLEILARSAKIGLASALQPRTVVCHCNAESQCLYNQTSRVGNSSLEVAGCKCDGGTFGRYC

EGSEDACEEPCFPSVHCVPGKGCEACPPNLTGDGRHCAALGSSFLCQNQSCPVNYCYNQGHCYISQTL

GCQPMCTCPPAFTDSRCFLAGNNFSPTVNLELPLRVIQLLLSEEENASMAEVNASVAYRLGTLDMRAFLR

NSQVERIDSAAPASGSPIQHWMVISEFQYRPRGPVIDFLNNQLLAAVVEAFLYHVPRRSEEPRNDVVFQPI

SGEDVRDVTALNVSTLKAYFRCDGYKGYDLVYSPQSGFTCVSPCSRGYCDHGGQCQHLPSGPRCSCVS

FSIYTAWGEHCEHLSMKLDAFFGIFFGALGGLLLLGVGTFVVLRFWGCSGARFSYFLNSAEALP (MUC1; human)
                                                              SEQ ID NO: 2
>sp|P15941|MUC1_HUMAN Mucin-1 OS = Homo sapiens GN = MUC1 PE = 1 SV = 2
MTPGTQSPFFLLLLLTVLTVVTGSGHASSTPGGEKETSATQRSSVPSSTEKNAVSMTSSVLSSHSPGSGS

STTQGQDVTLAPATEPASGSAATWGQDVTSVPVTRPALGSTTPPAHDVTSAPDNKPAPGSTAPPAHGVT

SAPDTRPAPGSTAPPAHGVTSAPDTRPAPGSTAPPAHGVTSAPDTRPAPGSTAPPAHGVTSAPDTRPAP

GSTAPPAHGVTSAPDTRPAPGSTAPPAHGVTSAPDTRPAPGSTAPPAHGVTSAPDTRPAPGSTAPPAHG

VTSAPDTRPAPGSTAPPAHGVTSAPDTRPAPGSTAPPAHGVTSAPDTRPAPGSTAPPAHGVTSAPDTRP

APGSTAPPAHGVTSAPDTRPAPGSTAPPAHGVTSAPDTRPAPGSTAPPAHGVTSAPDTRPAPGSTAPPA

HGVTSAPDTRPAPGSTAPPAHGVTSAPDTRPAPGSTAPPAHGVTSAPDTRPAPGSTAPPAHGVTSAPDT

RPAPGSTAPPAHGVTSAPDTRPAPGSTAPPAHGVTSAPDTRPAPGSTAPPAHGVTSAPDTRPAPGSTAP

PAHGVTSAPDTRPAPGSTAPPAHGVTSAPDTRPAPGSTAPPAHGVTSAPDTRPAPGSTAPPAHGVTSAP

DTRPAPGSTAPPAHGVTSAPDTRPAPGSTAPPAHGVTSAPDTRPAPGSTAPPAHGVTSAPDTRPAPGST
```

-continued

APPAHGVTSAPDTRPAPGSTAPPAHGVTSAPDTRPAPGSTAPPAHGVTSAPDTRPAPGSTAPPAHGVTS

APDTRPAPGSTAPPAHGVTSAPDTRPAPGSTAPPAHGVTSAPDTRPAPGSTAPPAHGVTSAPDTRPAPG

STAPPAHGVTSAPDTRPAPGSTAPPAHGVTSAPDTRPAPGSTAPPAHGVTSAPDTRPAPGSTAPPAHGV

TSAPDTRPAPGSTAPPAHGVTSAPDTRPAPGSTAPPAHGVTSAPDNRPALGSTAPPVHNVTS

ASGSASGSASTLVHNGTSARATTTPASKSTPFSIPSHHSDTPTTLASHSTKTDASSTHHSSVPPLTSSNHS

TSPQLSTGVSFFFLSFHISNLQFNSSLEDPSTDYYQELQRDISEMFLQIYKQGGFLGLSNIKFRPGSVVVQL

TLAFREGTINVHDVETQFNQYKTEAASRYNLTISDVSVSDVPFPFSAQSGAGVPGWGIALLVLVCVLVALAI

VYLIALAVCQCRRKNYGQLDIFPARDTYHPMSEYPTYHTHGRYVPPSSTDRSPYEKVSAGNGGSSLSYTN

PAVAAASANL (human MUC4 peptide)     SEQ ID NO: 3
PMTDTKTVTTPGSSFTA (human MUC4 peptide)     SEQ ID NO: 4
PGSSFTASGHSPSEIVPQD (human MUC4 peptide)     SEQ ID NO: 5
SEIVPQDAPTISAATTFAPA (human MUC4 peptide)     SEQ ID NO: 6
TTFAPAPTGNGHTTQAPTTA (human MUC4 peptide)     SEQ ID NO: 7
TTQAPTTALQAAPSSHD (human MUC4 peptide)     SEQ ID NO: 8
APSSHDATLGPSGGTSLSKT (human MUC4 peptide)     SEQ ID NO: 9
SLSKTGALTLANSVVSTP (human MUC4 peptide)     SEQ ID NO: 10
NSVVSTPGGPEGQWTSASAS (human MUC4 peptide)     SEQ ID NO: 11
TSASASTSPRTAAAMTHT (human MUC4 peptide)     SEQ ID NO: 12
AAAMTHTHQAESTEASGQT (human MUC4 peptide)     SEQ ID NO: 13
EASGQTQTSEPASSGSRTT (human MUC4 peptide)     SEQ ID NO: 14
PASSGSRTTSAGTATPSSS (human MUC4 peptide)     SEQ ID NO: 15
TATPSSSGASGTTPSGSEGI (human MUC4 peptide)     SEQ ID NO: 16
SGSEGISTSGETTRFSSN (human MUC4 peptide)     SEQ ID NO: 17
GETTRFSSNPSRDSHTT (human MUC4 peptide)     SEQ ID NO: 18
PVTSPSSASTGHTTPLPVTDTSSASTGDTTP -continued (human MUC4 peptide)
SEQ ID NO: 19
LPVTSLSSVSTGDTTPLPVTSPSSASTGH (human MUC4 peptide)
SEQ ID NO: 20
LPVTSPSSASTGHASPLLVTDASSASTGQ (human MUC4 peptide)
SEQ ID NO: 21
PLPVTSPSSASTGHASPLLVTDASSASTGQ (human MUC4 peptide)
SEQ ID NO: 22
STGDTLPLPVTDTSSV (human MUC4 peptide)
SEQ ID NO: 23
PVTYASSASTGDTTPLPVTDTSSVSTGHAT (human MUC1 peptide)
SEQ ID NO: 24
VTSAPDTRPAPGSTAPPAHG (human MUC2 peptide)
SEQ ID NO: 25
PTTTPITTTTVTPTPTPTGTQTPTTTPISTTC (MUC2 human)
SEQ ID NO: 26
>sp|Q02817|MUC2_HUMAN Mucin-2 OS = Homo sapiens GN = MUC2 PE = 1 SV = 2
MGLPLARLAAVCLALSLAGGSELQTEGRTRYHGRNVCSTWGNFHYKTFDGDVFRFPGLCDYNFASDCRG

SYKEFAVHLKRGPGQAEAPAGVESILLTIKDDTIYLTRHLAVLNGAVVSTPHYSPGLLIEKSDAYTKVYSRAG

LTLMWNREDALMLELDTKFRNHTCGLCGDYNGLQSYSEFLSDGVLFSPLEFGNMQKINQPDVVCEDPEE

EVAPASCSEHRAECERLLTAEAFADCQDLVPLEPYLRACQQDRCRCPGGDTCVCSTVAEFSRQCSHAGG

RPGNWRTATLCPKTCPGNLVYLESGSPCMDTCSHLEVSSLCEEHRMDGCFCPEGTVYDDIGDSGCVPVS

QCHCRLHGHLYTPGQEITNDCEQCVCNAGRWVCKDLPCPGTCALEGGSHITTFDGKTYTFHGDCYYVLA

KGDHNDSYALLGELAPCGSTDKQTCLKTVVLLADKKKNAVVFKSDGSVLLNQLQVNLPHVTASFSVFRPS

SYHIMVSMAIGVRLQVQLAPVMQLFVTLDQASQGQVQGLCGNFNGLEGDDFKTASGLVEATGAGFANTW

KAQSTCHDKLDWLDDPCSLNIESANYAEHWCSLLKKTETPFGRCHSAVDPAEYYKRCKYDTCNCQNNED

CLCAALSSYARACTAKGVMLWGWREHVCNKDVGSCPNSQVFLYNLTTCQQTCRSLSEADSHCLEGFAP

VDGCGCPDHTFLDEKGRCVPLAKCSCYHRGLYLEAGDVVVRQEERCVCRDGRLHCRQIRLIGQSCTAPKI

HMDCSNLTALATSKPRALSCQTLAAGYYHTECVSGCVCPDGLMDDGRGGCVVEKECPCVHNNDLYSSG

AKIKVDCNTCTCKRGRWVCTQAVCHGTCSIYGSGHYITFDGKYYDFDGHCSYVAVQDYCGQNSSLGSF

SIIITENVPCGTTGVTCSKAIKIFMGRTELKLEDKHRVVIQRDEGHHVAYTTREVGQYLVVESSTGIIVIWDKR

TTVFIKLAPSYKGTVCGLCGNFDHRSNNDFTTRDHMVVSSELDFGNSWKEAPTCPDVSTNPEPCSLNPH

RRSWAEKQCSILKSSVFSICHSKVDPKPFYEACVHDSCSCDTGGDCECFCSAVASYAQECTKEGACVFW

RTPDLCPIFCDYYNPPHECEWHYEPCGNRSFETCRTINGIHSNISVSYLEGCYPRCPKDRPIYEEDLKKCV

TADKCGCYVEDTHYPPGASVPTEETCKSCVCTNSSQVVCRPEEGKILNQTQDGAFCYWEICGPNGTVEK

HFNICSITTRPSTLTTFTTITLPTTPTSFTTTTTTTPTSSTVLSTTPKLCCLWSDWINEDHPSSGSDDGDRE

PFDGVCGAPEDIECRSVKDPHLSLEQHGQKVQCDVSVGFICKNEDQFGNGPFGLCYDYKIRVNCCWPMD

KCITTPSPPTTTPSPPPTTTTLPPTTTPSPTTTTTTPPPTTTPSPPITTTTTPLPTTTPSPPISTTTTPPPTT

TPSPPTTTPSPPTTTPSPPTTTTTTPPPTTTPSPPMTTPITPPASTTTLPPTTTPSPTTTTTTPPPTTTPSPP

TTTPITPPTSTTTLPPTTTPSPPPTTTTTPPPTTTPSPPTTTTPSPPTITTTTPPPTTTPSPPTTTTTTPPPTTT

PSPPTTTPITPPTSTTTLPPTTTPSPPPTTTTTPPPTTTPSPPTTTTPSPPITTTTTPPPTTTPSSPITTTPSPP

TTTMTTPSPTTTPSSPITTTTTPSSTTTPSPPPTTMTTPSPTTTPSPPTTMTTLPPTTTSSPLTTTPLPPSIT

-continued

```
PPTFSPFSTTTPTTPCVPLCNWTGWLDSGKPNFHKPGGDTELIGDVCGPGWAANISCRATMYPDVPIGQL
GQTVVCDVSVGLICKNEDQKPGGVIPMAFCLNYEINVQCCECVTQPTTMTTTTTENPTPPTTTPITTTTTVT
PTPTPTGTQTPTTTPITTTTTVTPTPTPTGTQTPTTTPITTTTTVTPTPTPTGTQTPTTTPITTTTTVTPTPTPT
GTQTPTTTPITTTTTVTPTPTPTGTQTPTTTPITTTTTVTPTPTPTGTQTPTTTPITTTTTVTPTPTPTGTQTPT
TTPITTTTTVTPTPTPTGTQTPTTTPITTTTTVTPTPTPTGTQTPTTTPITTTTTVTPTPTPTGTQTPTTTPITTT
TTVTPTPTPTGTQTPTTTPITTTTTVTPTPTPTGTQTPTTTPITTTTTVTPTPTPTGTQTPTTTPITTTTTVTPT
PTPTGTQTPTTTPITTTTTVTPTPTPTGTQTPTTTPITTTTTVTPTPTPTGTQTPTTTPITTTTTVTPTPTPTGT
QTPTTTPITTTTTVTPTPTPTGTQTPTTTPITTTTTVTPTPTPTGTQTPTTTPITTTTTVTPTPTPTGTQTPTTT
PITTTTTVTPTPTPTGTQTPTTTPITTTTTVTPTPTPTGTQTPTTTPITTTTTVTPTPTPTGTQTPTTTPITTTTT
VTPTPTPTGTQTPTTTPITTTTTVTPTPTPTGTQTPTTTPITTTTTVTPTPTPTGTQTPTTTPITTTTTVTPTPT
PTGTQTPTTTPITTTTTVTPTPTPTGTQTPTTTPITTTTTVTPTPTPTGTQTPTTTPITTTTTVTPTPTPTGTQT
PTTTPITTTTTVTPTPTPTGTQTPTTTPITTTTTVTPTPTPTGTQTPTTTPITTTTTVTPTPTPTGTQTPTTTPIT
TTTTVTPTPTPTGTQTPTTTPITTTTTVTPTPTPTGTQTPTTTPITTTTTVTPTPTPTGTQTPTTTPITTTTTVT
PTPTPTGTQTPTTTPITTTTTVTPTPTPTGTQTPTTTPITTTTTVTPTPTPTGTQTPTTTPITTTTTVTPTPTPT
GTQTPTTTPITTTTTVTPTPTPTGTQTPTTTPITTTTTVTPTPTPTGTQTPTTTPITTTTTVTPTPTPTGTQTPT
TTPITTTTTVTPTPTPTGTQTPTTTPITTTTTVTPTPTPTGTQTPTTTPITTTTTVTPTPTPTGTQTPTTTPITTT
TTVTPTPTPTGTQTPTTTPITTTTTVTPTPTPTGTQTPTTTPITTTTTVTPTPTPTGTQTPTTTPITTTTTVTPT
PTPTGTQTPTTTPITTTTTVTPTPTPTGTQTPTTTPITTTTTVTPTPTPTGTQTPTTTPITTTTTVTPTPTPTGT
QTPTTTPITTTTTVTPTPTPTGTQTPTTTPITTTTTVTPTPTPTGTQTPTTTPITTTTTVTPTPTPTGTQTPTTT
PITTTTTVTPTPTPTGTQTPTTTPITTTTTVTPTPTPTGTQTPTTTPITTTTTVTPTPTPTGTQTPTTTPITTTTT
VTPTPTPTGTQTPTTTPITTTTTVTPTPTPTGTQTPTTTPITTTTTVTPTPTPTGTQTPTTTPITTTTTVTPTPT
PTGTQTPTTTPITTTTTVTPTPTPTGTQTPTTTPITTTTTVTPTPTPTGTQTPTTTPITTTTTVTPTPTPTGTQT
PTTTPITTTTTVTPTPTPTGTQTPTTTPITTTTTVTPTPTPTGTQTPTTTPITTTTTVTPTPTPTGTQTPTTTPIT
TTTTVTPTPTPTGTQTPTTTPITTTTTVTPTPTPTGTQTPTTTPITTTTTVTPTPTPTGTQTPTTTPITTTTTVT
PTPTPTGTQTPTTTPITTTTTVTPTPTPTGTQTPTTTPITTTTTVTPTPTPTGTQTPTTTPITTTTTVTPTPTPT
GTQTPTTTPITTTTTVTPTPTPTGTQTPTTTPITTTTTVTPTPTPTGTQTPTTTPITTTTTVTPTPTPTGTQTPT
TTPITTTTTVTPTPTPTGTQTPTTTPITTTTTVTPTPTPTGTQTPTTTPITTTTTVTPTPTPTGTQTPTTTPITTT
TTVTPTPTPTGTQTPTTTPITTTTTVTPTPTPTGTQTPTTTPITTTTTVTPTPTPTGTQTPTTTPITTTTTVTPT
PTPTGTQTPTTTPITTTTTVTPTPTPTGTQTPTTTPITTTTTVTPTPTPTGTQTPTTTPITTTTTVTPTPTPTGT
QTPTTTPITTTTTVTPTPTPTGTQTPTTTPITTTTTVTPTPTPTGTQTPTTTPITTTTTVTPTPTPTGTQTPTTT
PITTTTTVTPTPTPTGTQTPTTTPITTTTTVTPTPTPTGTQTPTTTPITTTTTVTPTPTPTGTQTPTTTPITTTTT
VTPTPTPTGTQTPTTTPITTTTTVTPTPTPTGTQTPTTTPITTTTTVTPTPTPTGTQTPTTTPITTTTTVTPTPT
PTGTQTPTTTPITTTTTVTPTPTPTGTQTGPPTHTSTAPIAELTTSNPPPESSTPQTSRSTSSPLTESTTLLS
TLPPAIEMTSTAPPSTPTAPTTTSGGHTLSPPPSTTTSPPGTPTRGTTTGSSSAPTPSTVQTTTTSAWTPTP
TPLSTPSIIRTTGLRPYPSSVLICCVLNDTYYAPGEEVYNGTYGDTCYFVNCSLSCTLEFYNWSCPSTPSPT
PTPSKSTPTPSKPSSTPSKPTPGTKPPECPDFDPPRQENETWWLCDCFMATCKYNNTVEIVKVECEPPP
MPTCSNGLQPVRVEDPDGCCWHWECDCYCTGWGDPHYVTFDGLYYSYQGNCTYVLVEEISPSVDNFG
VYIDNYHCDPNDKVSCPRTLIVRHETQEVLIKTVHMMPMQVQVQVNRQAVALPYKKYGLEVYQSGINYVV
DIPELGVLVSYNGLSFSVRLPYHRFGNNTKGQCGTCTNTTSDDCILPSGEIVSNCEAAADQWLVNDPSKP
HCPHSSSTTKRPAVTVPGGGKTTPHKDCTPSPLCQLIKDSLFAQCHALVPPQHYYDACVFDSCFMPGSSL
```

ECASLQAYAALCAQQNICLDWRNHTHGACLVECPSHREYQACGPAEEPTCKSSSSQQNNTVLVEGCFCP

EGTMNYAPGFDVCVKTCGCVGPDNVPREFGEHFEFDCKNCVCLEGGSGIICQPKRCSQKPVTHCVEDGT

YLATEVNPADTCCNITVCKCNTSLCKEKPSVCPLGFEVKSKMVPGRCCPFYWCESKGVCVHGNAEYQPG

SPVYSSKCQDCVCTDKVDNNTLLNVIACTHVPCNTSCSPGFELMEAPGECCKKCEQTHCIIKRPDNQHVIL

KPGDFKSDPKNNCTFFSCVKIHNQLISSVSNITCPNFDASICIPGSITFMPNGCCKTCTPRNETRVPCSTVP

VTTEVSYAGCTKTVLMNHCSGSCGTFVMYSAKAQALDHSCSCCKEEKTSQREVVLSCPNGGSLTHTYTHI

ESCQCQDTVCGLPTGTSRRARRSPRHLGSG (MUC5AC, human)
                                                                SEQ ID NO: 27
>tr|O75372|O75372_HUMAN Gastric mucin (Fragment) OS = Homo sapiens
GN = MUC5AC PE = 1 SV = 21
MSVGRRKLALLWALALALACTRHTGHAQDGSSESSYKHHPALSPIARGPIGVPLRGATVF

PSLRTIPVVRASNPAHNGRVCSTWGSFHYKTFDGDVFRFPGLCNYVFSEHCGAAYEDFNI

PATPQPGVSGPHAEQGPHEGGWRGHPADQGLRPGQRPPGPAALQPVWGPHSARAAATPRW

KPGWALSSCGTTMTACCWKLDTKYANKNLWALWGLQRDARGQRAPLPQHQADTHGIREPA

ERWTNPRSSVRTLSLNPRRTAPLALASCEELLHGQLFSGCVALVDVGSYLEACRQDLCFC

EDTDLLSCVCHTLAEYSRQCTHAGGLPQDWRGPDFCPQKCPNNMQYHECRSPCADTCSNQ

EHSRACEDHCVAGCFCPEGTVLDDIGQTGCVPVSKCACVYNGAAYAPGATYSTDCTNCTC

SGGRWSCQEVPCPGTCSVLGGAHFSTFDGKQYTVHGDCSYVLTKPCDSSAFTVLAELRRC

GLTDSETCLKSVTLSLDGAQTVVVIKASGEVFLNQIYTQLPISAANVTIFRPSTFFIIAQ

TSLGLQLNLQLVPTMQLFMQLAPKLRGQTCGLCGNFNSIQADDFRTLSGVVEATAAAFFN

TFKTQAACPNIRNSFEDPCSLSVENEKYAQHWCSQLTDADGPFGRCHAAVKPGTYYSNCM

FDTCNCERSEDCLCAALSSYVHACAAKGVQLGGWRDGVCTKPMTTCPKSMTYHYHVSTCQ

PTCRSLSEGDITCSVGFIPVDGCICPKGTFLDDTGKCVQASNCPCYHRGSMIPNGESVHD

SGAICTCTHGKLSCIGGQAPAPVCAAPMVFFDCRNATPGDTGAGCQKSCHTLDMTCYSPQ

CVPGCVCPDGLVADGEGGCITAEDCPCVHNEASYRAGQTIRVGCNTCTCDSRMWRCTDDP

CLATCAVYGDGHYLTFDGQSYSFNEETASTRWCRTAVAGKTAPRTPFVLSPRTSPAAPQG

PPAPRPSRFSWGNFELKLSHGKVEVIGTDESQEVPYTIRQMGIYLVVDTDIGLVLLWDKK

TSIFINLSPEFKGRVCGLCGNFDDIAVNDFATRSRSVVGDVLEFGNSWKLSPSCPDALAP

KDPCTANPFRKSWAQKQCSILHGPTFAACHAHVEPARYYEACVNDACACDSGGDCECFCT

AVARYAQACHEVGTCVCLRTPSICPLFCDYYNPEGQCEWHYQPCGVPCLRTCRNPRGDCL

RDVRGLEGCYPKCPPEAPIFDEDKMQCVATCPTPPLPPRCHVGKSYRPGAVVPSDKNCQ

SCLCTERGVECTYKAEACVCTYNGQRFHPGDVIYHTTDGTGGCISARCGANGTIERRVYP

CSPTTPVPPTTFSFSTPPLVVSSTHTPSNGPSSAHTGPPSSAWPTTAGTSPRT (MUC6, human)
                                                                SEQ ID NO: 28
>sp|Q6W4X9|MUC6_HUMAN Mucin-6 OS = Homo sapiens GN = MUC6 PE = 1 SV = 2
MVQRWLLLSCCGALLSAGLANTSYTSPGLQRLKDSPQTAPDKGQCSTWGAGHFSTFDHHV

YDFSGTCNYIFAATCKDAFPSFSVQLRRGPDGSISRIIVELGASVVTVSEAIISVKDIGV

ISLPYTSNGLQITPFGQSVRLVAKQLELELEVVWGPDSHLMVLVERKYMGQMCGLCGNFD

GKVTNEFVSEEGKFLEPHKFAALQKLDDPGEICTFQDIPSTHVRQAQHARGCTQLLTLVA

PECSVSKEPFVLSCQADVAAAPQPGPQNSSYATLSEYSRQCSMVGQPVALRSPGLCSVGQ

CPANQVYQECGSACVKTCSNSEHSCSSSCTFGCFCPEGTDLNDLSNNHTCVPVTQCPCVL

HGAMYAPGEVTIAACQTCRCTLGRWVCTERPCPGHCSLEGGSFVTTFDARPYRFHGTCTY

```
ILLQSPQLPEDGALMAVYDKSGVSHSETSLVAVVYLSRQDKIVISQDEVVTNNGEAKWLP

YKTRNITVFRQTSTHLQMATSFGLELVVQLRPIFQAYVTVGPQFRGQTRGLCGNFNGDTT

DDFTTSMGIAEGTASLFVDSWRAGNCPDALERETDPCSMSQLNKVCAETHCSMLLRTGTV

FERCHATVNPAPIYKRCMYQACNYEETFPHICAALGDYVHACSLRGVLLWGWRSSVDNCT

IPCTGNTTFSYNSQACERTCLSLSDRATECHHSAVPVDGCNCPDGTYLNQKGECVRKAQC

PCILEGYKFILAEQSTVINGITCHCINGRLSCPQRLQMFLASCQAPKTFKSCSQSSENKF

GAACAPTCQMLATGVACVPTKCEPGCVCAEGLYENAYGQCVPPEECPCEFSGVSYPGGAE

LHTDCRTCSCSRGRWACQQGTHCPSTCTLYGEGHVITFDGQRFVFDGNCEYILATDVCGV

NYSQPTFKILTENVICGNSGVTCSRAIKIFLGGLSVVLADRNYTVTGEEPHVQLGVTPGA

LSLVVDISIPGRYNLTLIWNRHMTILIRIARASQDPLCGLCGNFNGNMKDDFETRSRYVA

SSELELVNSWKESPLCGDVSFVTDPCSLNAFRRSWAERKCSVINSQTFATCHSKVYHLPY

YEACVRDACGCDSGGDCECLCDAVAAYAQACLDKGVCVDWRTPAFCPIYCGFYNTHTQDG

HGEYQYTQEANCTWHYQPCLCPSQPQSVPGSNIEGCYNCSQDEYFDHEEGVCVPCMPPTT

PQPPTTPQLPTTGSRPTQVWPMTGTSTTIGLLSSTGPSPSSNHTPASPTQTPLLPATLTS

SKPTASSGEPPRPTTAVTPQATSGLPPTATLRSTATKPTVTQATTRATASTASPATTSTA

QSTTRTTMTLPTPATSGTSPTLPKSTNQELPGTTATQTTGPRPTPASTTGPTTPQPGQPT

RPTATETTQTRTTTEYTTPQTPHTTHSPPTAGSPVPSTGPVTATSFHATTTYPTPSHPET

TLPTHVPPFSTSLVTPSTHTVITPTHAQMASSASNHSAPTGTIPPPTTLKATGSTHTAPP

ITPTTSGTSQAHSSFSTNKTPTSLHSHTSSTHHPEVTPTSTTSITPNPTSTRTRTPMAHT

NSATSSRPPPPFTTHSPPTGSSPFSSTGPMTATSFKTTTTYPTPSHPQTTLPTHVPPFST

SLVTPSTHTVITPTHAQMATSASIHSMPTGTIPPPTTLKATGSTHTAPTMTLTTSGTSQA

LSSLNTAKTSTSLHSHTSSTHHAEATSTSTTNITPNPTSTGTPPMTVTTSTRTPVAHTTS

ATSSRLPTPFTTHSPPTGTTPISSTGPVTATSFQTTTTYPTPSHPHTTLPTHVPSFSTSL

VTPSTHTVIIPTHTQMATSASIHSMPTGTIPPPTTIKATGSTHTAPPMTPTTSGTSQSPS

SFSTAKTSTSLPYHTSSTHHPEVTPTSTTNITPKHTSTGTRTPVAHTTSASSSRLPTPFT

THSPPTGSSPFSSTGPMTATSFQTTTTYPTPSHPQTTLPTHVPPFSTSLVTPSTHTVIIT

THTQMATSASIHSTPTGTVPPPTTLKATGSTHTAPPMTVTTSGTSQTHSSFSTATASSSF

ISSSSWLPQNSSSRPPSSPITTQLPHLSSATTPVSTTNQLSSSFSPSPSAPSTVSSYVPS

SHSSPQTSSPSVGTSSSFVSAPVHSTTLSSGSHSSLSTHPTTASVSASPLFPSSPAASTT

IRATLPHTISSPFTLSALLPISTVTVSPTPSSHLASSTIAFPSTPRTTASTHTAPAFSSQ

STTSRSTSLTTRVPTSGFVSLTSGVTGIPTSPVTNLTTRHPGPTLSPTTRFLTSSLTAHG

STPASAPVSSLGTPTPTSPGVCSVREQQEEITFKGCMANVTVTRCEGACISAASFNIITQ

QVDARCSCCRPLHSYEQQLELPCPDPSTPGRRLVLTLQVFSHCVCSSVACGD (MUC7, human)
                                                                  SEQ ID NO: 29
>sp|Q8TAX7|MUC7_HUMAN Mucin-7 OS = Homo sapiens GN = MUC7 PE = 1 SV = 1
MKTLPLFVCICALSACFSFSEGRERDHELRHRRHHHQSPKSHFELPHYPGLLAHQKPFIR

KSYKCLHKRCRPKLPPSPNNPPKFPNPHQPPKHPDKNSSVVNPTLVATTQIPSVTFPSAS

TKITTLPNVTFLPQNATTISSRENVNTSSSVATLAPVNSPAPQDTTAAPPTPSATTPAPP

SSSAPPETTAAPPTPSATTQAPPSSSAPPETTAAPPTPPATTPAPPSSSAPPETTAAPPT

PSATTPAPLSSSAPPETTAVPPTPSATTLDPSSASAPPETTAAPPTPSATTPAPPSSPAP
```

```
QETTAAPITTPNSSPTTLAPDTSETSAAPTHQTITSVTTQTTTTKQPTSAPGQNKISRFL

LYMKNLLNRIIDDMVEQ (recMUC4)
                                                    SEQ ID NO: 30
PMTDTKTVTTPGSSFTASGHSPSEIVPQDAPTISAATZFAPAPTGNGHTTQAPTTALQAAPSSHDATLGPS

GGTSLSKTGALTLANSVVSTPGGPEGQWTSASASTSPDTAAAMTHTHQAESTEASGQTQTSEPASSGSR

TTSAGTATPSSSGASGTTPSGSEGISTSGETTRFSSNPSRDSHTT (recMUC1)
                                                    SEQ ID NO: 31
MGSSHHHHHHSSGLVPRGSHMASMTGGQQMGRDPNSVTSAPDTRPAPGSTAPQAHGVTSAPDTRPAP

GSTAPPAHGVTSAPDTRPAPGSTAPPAHGVTSAPDT (recMUC2)
                                                    SEQ ID NO: 32
MGSSHHHHHHSSGLVPRGSHMASMTGGQQMGRDPNSSSVDKLDIEFLQPGGSVQCCECVTQPTTMTT

TTTENPTPTPITTTTVTPTPTPTSTQSTTPTPITTTNTVTPTPTPTGTQT (recMUC5AC)
                                                    SEQ ID NO: 33
MGSSHHHHHHSSGLVPRGSHMASMTGGQQMGRIPTSSTTSTPQTSTTSASTTSITSGPGTTPSPVPTTS

TTSAPTTSTTSAATTSTISAPTTSTTSAPTTSTTSASTASKTSGLGTTPSPIPTTSTTSPPTTSTTSASTASKT

SGPGTTPSPVPTTSTIFAPRTSTTSASTTSTTPGPGTTPSPVPTTSTASVSKTSTSHVSISKTTHSQAAALE

HHHHHH (recMUC6)
                                                    SEQ ID NO: 34
MGSSHHHHHHSSGLVPRGSHMASMTGGQQMGRIRSTSLVTPSTHTVITPTHAQMATSASNHSAPTGTIP

PPTTLKATGSTHTAPPITPTTSGTSQAHSSFSTNKAAALEHHHHHH (recMUC7)
                                                    SEQ ID NO: 35
MGSSHHHHHHSSGLVPRGSHMASMTGGQQMGRIPAPQDTTAAPPTPSATTPAPPSSSAPPETTAAPPTP

SATTQAPPSSSAPPETTAAPPTPPATTPAPPSSSAPPETTAAPPTPSATTPAPLSSSAPPETTAVPPTPSAT

TLDPSSASAPPETTAAPPTPSATTPAPPSSPAPQETTAAPITTPNSSPTTLAPDTSETSAAPTHQTTTSVTT

QTTTTKQPTSAPAAALEHHHHHH (hMUC3)
                                                    SEQ ID NO: 36
MQLLGLLGLLWMLKASPWATGTLSTATSISQVPFPRAEAASAVLSNSPHSRDLAGWPLGV

PQLASPAPGHRENAPMTLTTSPHDTLISETLLNSPVSSNTSTTPTSKFAFKVETTPPTVL

VYSATTECVYPTSFIITISHPTSICVTTTQVAFTSSYTSTPVTQKPVTTVTSTYSMTTTE

KGTSAMTSSPSTTTARETPIVTVTPSSVSATDTTFHTTISSTTRTTERTPLPTGSIHTTT

SPTPVFTTLKTAVTSTSSITSSITSTNTVTSMTTTASQPTATNTLSSPTRTILSSTPVLS

TETITSGITNTTPLSTLVTTLPTTISRSTPTSETTYPTSPXXXXXXXXXXAMTSPPPVSS

SITPTNTMTSMRTTTYWPTATNTLSPLTSSILSSTPVPSTEMITSHTTNTTPLSTLVTTL

LTTITRSTPTSETTYPTSPTSIVSDSTTEITYSTSITGTLSTATTLPPTSSSLPTTETAT

MTPTTTLITTTPNTTSHSTPSFTSSTIYSTVSTSTTAISSASPTSGTMVTSTTMTPSSLS

TDTPSTTPTTITYPSVGSTGFLTTATDLTSTFTVSSSSAMSKSVIPSSPSIQNTETSSLV

SMTSATTPSLRPTITSTDSTLTSSLLTTFPSTYSFSSSMSASSAGTTHTETISSLPASTN

TIHTTAESALAPTTTTSFTTSPTMEPPSTTVATTGTGQTTFPSSTATFLETTTLTPTTDF

STESLTTAMTSTPPITSSITPTDTMTSMRTTTSWPTATNTLSPLTSSILSSTPVPSTEVT

TSHTTNTNPVSTLVTTLPITITRSTLTSETAYPSSPTSTVTESTTEITYPTTMTETSSTA
```

```
TSLPPTSSLVSTAETAKTPTTNLXXXXXXXXXXFTSSTSLLHSQHTTXLPSPSVPTTLGT

MVTSTSXIPSSLSTDIPTSQPTTITPSSVGITGSLPMMTDLTSVYTVSSMSARPTSVIPS

SPTVQNTETSIFVSMMSATTPSGGSTFTSTENTPTRSLLTSFPVTHSFSSSMSASSVGTT

HTQSISSPPAITSTLHTTAESTPSPTTTMSFTTFTKMETPSSTVATTGTGQTTFTSSTAT

SPKTTTLTPTSDISTGSFKTAVSSTPPITSSITSTYTVTSMTTTTPLGPTATNTLPSFTS

SVSSSTPVPSTEAITSGTTNTTPLSTLVTTFSNSDTSSTPTSETTYPTSLTSALTDSTTR

TTYSTNMTGTLSTVTSLRPTSSSLLTTVTATVPTTNLVTTTTKITSHSTPSFTSSIATTE

TPSHSTPRFTSSITTTETPSHSTPRFTSSITNTKTTSHSSPSFTSSITTTDSIVXXXXXX

XXXXITITETTSHSTPSYTTSITTTETPSHSTPSYTTSITTTETPSHSTPSFTSSITTTE

TTSHSTPSFTSSIRTTETTSYSTPSFTSSNTITETTSHSTPSYITSITTTETPSSSTPSF

SSSITTTETTSHSTPGFTSSITTTETTSHSTPSFTSSITTTETTSHDTPSFTSSITTSET

PSHSTPSSTSLITTTKTTSHSTPSFTSSITTTETTSHSARSFTSSITTTETTSHNTRSFT

SSITTTETNSHSTTSFTSSITTTETTSHSTPSFSSSITTTETPLHSTPGLPSWVTTTKTT

SHITPGLTSSITTTETTSHSTPGFTSSITTTETTSESTPSLSSSTIYSTVSTSTTAITSH

FTTSETAVTPTPVTPSSLSTDIPTTSLRTLTPSSVGTSTSLTTTTDFPSIPTDISTLPTR

THIISSSPSIQSTETSSLVGTTSPTMSTVRMTLRITENTPISSFSTSIVVIPETPTQTPP

VLTSATGTQTSPAPTTVTFGSTDSSTSTLHTLTPSTALSTIVSTSQVPIPSTHSSTLQTT

PSTPSLQTSLTSTSEFTTESFTRGSTSTNAILTSFSTIIWSSTPTIIMSSSPSSASITPV

FSTTIHSVPSSPYIFSTENVGSASITGFPSLSSSATTSTSSTSSSLTTALTEITPFSYIS

LPSTTPCPGTITITIVPASPTDPCVEMDPSTEATSPPTTPLTVFPFTTEMVTCPTSISIQ

TTLTTYMDTSSMMPESESSISPNASSSTGTGTVPTNTVFTSTRLPTSETWLSNSSVIPLP

LPGVSTIPLTMKPSSSLPTILRTSSKSTHPSPPTTRTSETPVATTQTPTTLTSRRTTRIT

SQMTTQSTLTTTAGTCDNGGTWEQGQCACLPGFSGDRCQLQTRCQNGGQWDGLKCQCPST

FYGSSCEFAVEQVDLDVVETEVGMEVSVDQQFSPDLNDNTSQAYRDFNKTFWNQMQKIFA

DMQGFTFKGVEILSLRNGSIVVDYLVLLEMPFSPQLESEYEQVKTTLKEGLQNASQDANS

CQDSQTLCFKPDSIKVNNNSKTELTPEAICRRAAPTGYEEFYFPLVEATRLRCVTKCTSG

VDNAIDCHQGQCVLETSGPACRCYSTDTHWFSGPRCEVAVHWRALVGGLTAGAALLVLLL

LALGVRAVRSGWWGGQRRGRSWDQDRKWFETWDEEVVGTFSNWGFEDDGTDKDTNFHVAL

ENVDTTMKVHIKRPEMTSSSV (hMUC3B)
```

SEQ ID NO: 37

```
MQLLGLLSILWMLKSSPGATGTLSTATSTSHVTFPRAEATRTALSNSPHSRYLAEWPQGV

PQLASPAPGHRENAPMTLTTSPHDTLISETLLSSLVSSNTSTTPTSKFAFKVETTPPTVL

VYSATTECVYPTSFIITISHSTSICVTTTQVTFTSSYTPTPVTQKPVTTVTRTYPMTTTE

KGTSAMISSPSTTTARETPIVTVTPSSSVSATDTTFHTTISSTTRTTERTPLPTGSIHTT

MSPTPVFTTLKTAVTSTSPITSTITSTNTVTSMTTTTSRPTATNTLSSLTSSILSSTPAP

NTEVITSHTTTTTPPSTLVTTLPTAIARSTPTSETTXXXXXXXXXXXTIYSTVSSSTTAIT

SPFTTAETGVTSTPSSPSSLSTDIPTTSLRTLTPLSLSTSTSLTTTTDLPSIPTDISSLP

TPIHIISSSPSIQSTETSSLVGTTSPTMSTVRATLRSTENTPISSFSTSIVVTPETPTTQ

APPVLMSATGTQTSPVPTTVTFGSMDSSTSTLHTLTPSTALSKIMSTSQFPIPSTHSSTL

QTTPSIPSLQTSLTSTSEFTTESFTRGSTSTNAILTSFSTIIWSSTPTIIMSSSPSSASI
```

-continued

```
TPVFATTIHSVPSSPYIFSTENVGSASITAFPSLSSSSTTSTSPTSSSLTTALTEITPFS

YISLPSTTPCPGTITITIVPASPTDPCVEMDPSTEATSPPTTPLTVFPFTTEMVTCPSSI

SMQTTLATHMDTSSMTPESESSIIPNASSSTGTGTVPTNTVFTSTRLPTSETWLSNNSVI

PTPLPGVSTIPLTMKPSSSLPTILRTSSKSTHPSPPTARTSETSVATTQTPTTLTTRRTT

PITSWMTTQSTLTTTAGTCDNGGTWEQGQCACLPGFSGDRCQLQTRCQNGGQWDGLKCQC

PSTFYGSSCEFAVEQVDLDVVETEVGMEVSVDQQFSPDLNDNTSQAYRDFNKTFWNQMQK

IFADMQGFTFKGVEILSLRNGSIVVDYLVLLEMPFSPQLESEYEQVKTTLKEGLQNASQD

ANSCQDSQTLCFKPDSIKVNNNSKTELTPEAICRRAAPTGYEEFYFPLVEATRLRCVTKC

TSGVDNAIDCHQGQCVLETSGPACRCYSTDTHWFSGPRCEVAVHWRALVGGLTAGAALLV

LLLLALGVRAVRSGWWGGQRRGRSWDQDRKWFETWDEEVVGTFSNWGFEDDGTDKDTNFH

VALENVDTTMKVHIKRPEMTSSSV
```

(hMUC5B)
SEQ ID NO: 38

```
MGAPSACRTLVLALAAMLVVPQAETQGPVEPSWGNAGHTMDGGAPTSSPTRRVSFVPPVTVFPSLSPLN

PAHNGRVCSTWGDFHYKTFDGDVFRFPGLCNYVFSEHCRAAYEDFNVQLRRGLVGSRPVVTRVVIKAQG

LVLEASNGSVLINGQREELPYSRTGLLVEQSGDYIKVSIRLVLTFLWNGEDSALLELDPKYANQTCGLCGDF

NGLPAFNEFYAHNARLTPLQFGNLQKLDGPTEQCPDPLPLPAGNCTDEEGICHRTLLGPAFAECHALVDS

TAYLAACAQDLCRCFTCPCATFVEYSRQCAHAGGQPRNWRCPELCPRTCPLNMQHQECGSPCTDTCSN

PQRAQLCEDHCVDGCFCPPGSTVLDDITHSGCLPLGQCPCTHGGRTYSPGTSFNTTCSSCTCSGGLWQ

CQDLPCPGTCSVQGGAHISTYDEKLYDLHGDCSYVLSKKCADSSFTVLAELRKCGLTDNENCLKAVTLSL

DGGDTAIRVQADGGVFLNSIYTQLPLSAANITLFTPSSFFIVVQTGLGLQLLVQLVPLMQVFVRLDPAHQGQ

MCGLCGNFNQNQADDFTALSGVVEATGAAFANTVVKAQAACANARNSFEDPCSLSVENENYARHWCSRL

TDPNSAFSRCHSIINPKPFHSNCMFDTCNCERSEDCLCAALSSYVHACAAKGVQLSDWRDGVCTKYMQN

CPKSQRYAYVVDACQPTCRGLSEADVTCSVSFVPVDGCTCPAGTFLNDAGACVPAQECPCYAHGTVLAP

GEVVHDEGAVCSCTGGKLSCLGASLQKSTGCAAPMVYLDCSNSSAGTPGAECLRSCHTLDVGCFSTHCV

SGCVCPPGLVSDGSGGCIAEEDCPCVHNEATYKPGETIRVDCNTCTCRNRRWECSHRLCLGTCVAYGD

GHFITFDGDRYSFEGSCEYILAQDYCGDNTTHGTFRIVTENIPCGTTGTTCSKAIKLFVESYELILQEGTFKA

VARGPGGDPPYKIRYMGIFLVIETHGMAVSWDRKTSVFIRLHQDYKGRVCGLCGNFDDNAINDFATRSRS

VVGDALEFGNSWKLSPSCPDALAPKDPCTANPFRKSWAQKQCSILHGPTFAACRSQVDSTKYYEACVND

ACACDSGGDCECFCTAVAAYAQACHDAGLCVSWRTPDTCPLFCDFYNPHGGCEWHYQPCGAPCLKTC

RNPSGHCLVDLPGLEGCYPKCPPSQPFFNEDQMKCVAQCGCYDKDGNYYDVGARVPTAENCQSCNCT

PSGIQCAHSLEACTCTYEDRTYSYQDVIYNTTDGLGACLIAICGSNGTIIRKAVACPGTPATTPFTFTTAWVP

HSTTSPALPVSTVCVREVCRWSSWYNGHRPEPGLGGGDFETFENLRQRGYQVCPVLADIECRAAQLPD

MPLEELGQQVDCDRMRGLMCANSQQSPPLCHDYELRVLCCEYVPCGPSPAPGTSPQPSLSASTEPAVP

TPTQTTATEKTTLWVTPSIRSTAALTSQTGSSSGPVTVTPSAPGTTTCQPRCQWTEWFDEDYPKSEQLGG

DVESYDKIRAAGGHLCQQPKDIECQAESFPNWTLAQVGQKVHCDVHFGLVCRNWEQEGVFKMCYNYRI

RVLCCSDDHCRGRATTPPPTTELETATTTTTQALFSTPQPTSSPGLTRAPPASTTAVPTLSEGLTSPRYTS

TLGTATTGGPRQSAGSTEPTVPGVATSTLPTRSALPGTTGSLGTWRPSQPPTLAPTTMATSRARPTGTAS

TASKEPLTTSLAPTLTSELSTSQAETSTPRTETTMSPLTNTTTSQGTTRCQPKCEWTEWFDVDFPTSGVA

SGDMETFENIRAAGGKMCWAPKSIECRAENYPEVSIDQVGQVLTCSLETGLTCKNEDQTGRFNMCFNYN

VRVLCCDDYSHCPSTLATSSTATPSSTPGTTWILTKPTTTATTTASTGSTATASSTQATAGTPHVSTTATTP

TVTSSKATPFSSPGTATALPALRSTATTPTATSFTAIPSSSLGTTVVTRLSQTTTPMATMSTATPSSTPETVH
```

```
TSTVLTTTATTTGATGSVATPSSTPGTAHTTKVLTTTTTGFTATPSSSPGRARTLPVWISTTTTPTTRGSTV
TPSSIPGTTHTPTVLTTTTTTVATGSMATPSSSTQTSGTPPSLTTTATTITATGSTTNPSSTPGTTPIPPVLTT
TATTPAATSSTVTPSSALGTTHTPPVPNTTATTHGRSLSPSSPHTVCTAWTSATSGILGTTHITEPSTGTSH
TPAATTGTTQHSTPALSSPHPSSRTTESPPSPGTTTPGHTTATSRTTATATPSKTRTSTLLPSQPTSAPITT
VVTMGCEPQCAWSEWLDYSYPMPGPSGGDFDTYSNIRAAGGAVCEQPLGLECRAQAQPGVPLRELGQ
VVECSLDFGLVCRNREQVGKFKMCFNYEIRVFCCNYGHCPSTPATSSTATPSSTPGTTWILTELTTTATTT
ESTGSTATPTSTLRTAPPPKVLTTTATTPTVTSSKATPSSSPGTATALPALRSTATTPTATSVTPIPSSSLGT
TWTRLSQTTTPTATMSTATPSSTPETAHTSTVLTATATTTGATGSVATPSSTPGTAHTTKVPTTTTTGFTA
TPSSSPGTALTPPVWISTTTTPTTRGSTVTPSSIPGTTHTATVLTTTTTTVATGSMATPSSSTQTSGTPP
SLTTTATTITATGSTTNPSSTPGTRPIPPVLTTTATTPAATSSTVTPSSALGTTHTPPVPNTTATTHGRS
LSPSSPHTVRTAWTSATSGTLGTTHITEPSTGTSHTPAATTGTTQHSTPALSSPHPSSRTTESPPSPGTT
TPGHTTATSRTTATATPSKTRTSTLLPSSPTSAPITTVVTMGCEPQCAWSEWLDYSYPMPGPSGGDFDTY
SNIRAAGGAVCEQPLGLECRAQAQPGVPLRELGQVVECSLDFGLVCRNREQVGKFKMCFNYEIRVFCCN
YGHCPSTPATSSTATPSSTPGTTWILTEQTTAATTTATTGSTAIPSTPGTAPPPKVLTSQATTPTATSSK
ATSSSSPRTATTLPVLTSTATKSTATSFTPIPSSTLGTTGTSQNRPPHPMATMSTIHPSSTPETTHTSTV
LTTKATTTRATSSMSTPSSTPGTTWILTELTTAATTTAALPHGTPSSTPGTTWILTEPSTTATVTVPTGS
TATASSTRATAGTLKVLTSTATTPTVISSRATPSSSPGTATALPALRSTATTPTATSVTAIPSSSLGTAW
TRLSQTTTPTATMSTATPSSTPETVHTSTVLTTTATTTRTGSVATPSSTPGTAHTTKVPTTTTTGFTATP
SSSPGTALTPPVWISTTTTPTTRGSTVTPSSIPGTTHTATVLTTTTTTVATGSMATPSSSTQTSGTPPSL
TTTATTITATGSTTNPSSTPGTTPIPPVLTTTATTPAATSSTVTPSSALGTTHTPPVPNTTATTHGRSLP
PSSPHTVPTAWTSATSGILGTTHITEPSTGTSHTPAATTGTTQPSTPALSSPHPSSRTTESPPSPGTTTP
GHTRGTSRTTATATPSKTRTSTLLPSSPTSAPITTVVTTGCEPQCAWSEWLDYSYPMPGPSGGDFDTYSN
IRAAGGAVCEQPLGLECRAQAQPGVPLRELGQVVECSLDFGLVCRNREQVGKFKMCFNYEIRVFCCNYG
HCPSTPATSSTATPSSTPGTTWILTKLTTTATTTESTGSTATPSSTQGPPAGTPHVSTTATTPTVTSSKAT
PFSSPGTATALPALRSTATTPTATSFTAIPSSSLGTTWTRLSQTTTPMATMSTATPSSTPETVHTSTVLT
TTATTTGATGSVATPSSTPGTAHTTKVPTTTTTGFTVTPSSSPGTARTPPVWISTTTTPTTSGSTVTPSS
IPGTTHTPTVLTTTTQPVATGSMATPSSSTQTSGTPPSLITTATTITATGSTTNPSSTPGTTPIPPELTT
TATTPAATSSTVTPSSALGTTHTPPVPNTTATTHGRSLSPSSPHTVRTAWTSATSGTLGTTHITEPSTGT
SHTPAATTGTTTSTPALSSPHPSSRTTESPPSPGTTTPGHTTATSRTTATATPSKTRTSTLLPSQPTSA
PITTVVTTGCEPQCAWSEWLDYSYPMPGPSGGDFDTYSNIRAAGGAVCEQPLGLECRAQAQPGVPLGEL
GQVVECSLDFGLVCRNREQVGKFKMCFNYEIRVFCCNYGHCPSTPATSSTAMPSSTPGTTWILTELTTTA
TTTASTGSTATPSSTPGTAPPPKVLTSPATTPTATSSKATSSSSPRTATTLPVLTSTATKSTATSVTPIPS
STLGTTGTLPEQTTTPVATMSTIHPSSTPETTHTSTVLTTKATTTRATSSTSTPSSTPGTTWILTELTTAA
TTTAGTGPTATPSSTPGTTWILTELTTTATTTASTGSTATLSSTPGTTWILTEPSTTATVTVPTGSTATA
SSTQATAGTPHVSTTATTPTVTSSKATPSSSPGTATALPALRSTATTPTATSFTAIPSSSLGTTWTRLSQ
TTTPTATMSTATPSSTPETVHTSTVLTTTATTTGATGSVATPSSTPGTAHTTKVPTTTTTGFTATPSSSP
GTALTPPVWISTTTTPTTTTPTTSGSTVTPSSIPGTTHTARVLTTTTTTVATGSMATPSSSTQTSGTPPS
LTTTATTITATGSTTNPSSTPGTTPIPPVLTSMATTPAATSSKATSSSSPRTATTLPVLTSTATKSTATS
FTPIPSSTLWTTWTVPAQTTTPMSTMSTIHTSSTPETTHTSTVLTTTATMTRATNSTATPSSTLGTTRIL
TELTTTATTTAATGSTATLSSTPGTTWILTEPSTIATVMVPTGSTATTSSTLGTAHTPKVVTAMATMPTA
```

-continued

TASTVPSSSTVGTTRTPAVLPSSLPTFSVSTVSSSVLTTLRPTGFPSSHFSTPCFCRAFGQFFSPGEVIY

NKTDRAGCHFYAVCNQHCDIDRFQGACPTSPPPVSSAPLSSPSPAPGCDNAIPLRQVNETWTLENCTVA

RCVGDNRVVLLDPKPVANVTCVNKHLPIKVSDPSQPCDFHYECECICSMWGGSHYSTFDGTSYTFRGNC

TYVLMREIHARFGNLSLYLDNHYCTASATAAAARCPRALSIHYKSMDIVLTVTMVHGKEEGLILFDQIPVSS

GFSKNGVLVSVLGTTTMRVDIPALGVTVTFNGQVFQARLPYSLFHNNTEGQCGTCTNNQRDDCLQRDGT

TAASCKDMAKTVVLVPDSRKDGCWAPTGTPPTASPAAPVSSTPTPTPCPPQPLCDLMLSQVFAECHNLVP

PGPFFNACISDHCRGRLEVPCQSLEAYAELCRARGVCSDWRGATGGLCDLTCPPTKVYKPCGPIQPATC

NSRNQSPQLEGMAEGCFCPEDQILFNAHMGICVQACPCVGPDGFPKFPGERWVSNCQSCVCDEGSVSV

QCKPLPCDAQGQPPPCNRPGFVTVTRPRAENPCCPETVCVCNTTTCPQSLPVCPPGQESICTQEEGDCC

PTFRCRPQLCSYNGTFYGVGATFPGALPCHMCTCLSGDTQDPTVQCQEDACNNTTCPQGFEYKRVAGQ

CCGECVQTACLTPDGQPVQLNETWVNSHVDNCTVYLCEAEGGVHLLTPQPASCPDVSSCRGSLRKTGC

CYSCEEDSCQVRINTTILWHQGCETEVNITFCEGSCPGASKYSAEAQAMQHQCTCCQERRVHEETVPLH

CPNGSAILHTYTHVDECGCTPFCVPAPMAPPHTRGFPAQEATAV (MUC8 [Homo sapiens])

SEQ ID NO: 39

MLEFWAQVLPRDQPPSLEFWAQVLPREGLLWEPSLTEESSWATCWMGSPWEGWWFWGWFWGWFLT

DAYLPACGPGCVSPGARITVTGHPTQDSEPPWGLPGPWAELAARTPPPTLPLTSWCGAGWTSCACLVF

QFVCSHICPLLPRAGWGALEGRDCSGKETSRPVACRARKWREWLGCPDGGRQPRVAQASAVWQVQLK

NWIIHFTYRLQSKIQKPVGLVATMLDREVLDRLAWAPASAVPPTQNILGKGFNVLPSSRLQSGGGVAMRR

PAVGGVKAPGCVRIGVRVNGGLRPTTGGRCEHTQLSPPQGSPPLTSEVLWGWSGTTLREPWVGMHHS

QGPGTIRAVGGCSSSPPAPPHPLPQLLPAKTPFLSTLLEAHSSCPQLLPSPEGSALWPHHQPRSLSCSRH

TPQLSSFQPARVPFLLTSHPRALILPTRPGQSPEWCYEHRWAPGWHISSSIVATGLCFRESFPAICKALCK

VNGCEIVFKIQFGATDPNEALEISQAICPLGFKLACGVTAKKEKVCSISCSPQPHLRAGCQLQPSACTPLPS

RNGTSVYFGCIVCSCGRLVTQQVLRPHASLEKEQRNVSQLLLGERCVTNSPWALSDNALLTGLQGDKR

GFASSFGLWLGPAIIHWPLSVGCRRSFSLSGSGGRAEPYKPRRSPCLKPHVVSVKEVSRLGPASTGQRS

RAFCSGGVRWLSLSCRRPRRHQSGGLFLALQLECALSHMSRQLSVWSPQRAPFQSSCSRGCAVAWFR

ACCSSAGRPLPVHPGEQACSLRRGLRPAVLSPGPSLSPKPQPNATPSRGRWWLCVRWALLSSREFLRIFI

ARWLWVRADHRKPAGTLESRSGMQKAEGATRSSQVTLLPSCDCCRPPVPAPQRAWAVPGLQHRGLQP

PPAIAPPSLCQEHWSLPVSSSGRYVTVMMSVSSHAPGSPRYHTYLSLLAATPWPSLESVSAGHAPYAVRE

CTSLHRCSHQKGTLQVGRRVLVPGPGPRVCPLQWGAQPGVGSGCGKEERPGTSSRDELGLFPLKVAEM

QTQSSPYLWGSRQAPASGRAGFRQQPTPRGVPDRLRLQAGLDSGSTPYPVGFLTGPGFRQGWIQAAPR

TRWGSRHALASGRAGFRQHPVPAGVPDMPRLQAGLDSGSTPYPVGFLTGPGFRQGWIQAAPRTRWGS

RHALASAGLDSGTGVPAASALSGELRGSMSTGKIEFYEALSKVPSPLRMGSSGCQVPAARGCEAVTDRP

RSTETTDRGGRGGPQNQMGTDTVGGQVPTRGPPASLDQHRGSSLHPTYPLPRSVPATPRSSLDIVSRLP

HTSLRGPGSSLDTFLLLVPHCWFLGPSCSHLPCPAGPGYVPVMSGLRPGYVQVMSRLCSGYVLVRSRLC

PGQVRVRFRLFLGYVWLGPGYVRVMSQLGPGYVQVVSGLGPGYFQVMSRLGPGYVRVTSRLRPGYVQ

VRSRLGPGYVALGPGQVRVMSGLCPGQVPVISGLCPGQVLLCSGYFQVRSQLGLGASVSHCCVPAMAN

LSVCGRERSHSSQLCRSAAGLPSTPGRSHARLEPGRLCFPMRDQGTGEPGLGGIRQCLQRLGKMPLC

DEERRTHKDVIRFSSCPLAPLLALNAALGAYAPESCGSLFALMRQRAPGGRANVLTQWGRKTETTEWGA

GGLDQLPPDISSGKELSVQFELLFVGCSVTCILWIWPLAATGQHQFGETKTCLYSGREAFNVGTGTQMSE

GLCGHRGHEGAGELGTLSVPTGLDTRGLGCSRANGTGHEGAGTLPGPMGLALVTCRAGFLAASVQVFP

EETAVCVRVAEVKMTCPQCGWHLPAGVWREQKQKRGMCLSPRQLGCTLPLLPSDRTAGAPAFGLKDSH

-continued

WQPRVSRLWPRAESRHQLPGFGCLLTWTEPHYRHPVLSSLQTACCGTSQPPSSGSPNRPCSLLSLCHV

GSVSLETPDKHSCAGGEGSEEAVLWVTVCPQYHSLESQPPEPQNVTLLEIGSLQMKLQMLKGSSQIWLV

STSKHWPPCEKTHRPRGDGVWGREQRLQGRNHTGGKANTTRNRKRHGSSPGASGGSVAPITLVLDIRS

LNLKGRHFCASSCTFFFFLTASYSVAQAGVQCRDLSSPPSLPPGFKRFSCLSLPSSWVYRCSPLYLVNFCI

FSKDRVSPCWSGWSGTPDVKGSTRLGLSNCEDYRREPLHPTFTALCYGAWETTTGCSKKGSFYPTQMR

AQQDSLREAHSAQGPGLLMGGGRWVPGGAASLVWRPNSFPSSWQGHLEAQLQGSLGHTGCGRPARS

CTVPQGGGAARRKCQGPGASWTVWKFLFPECIISPSKIPQTQTKPTEADQRVGCSSSGGNGPGSQCLSG

GHRGHKGCQPGRNQCTSTTSCPRPLQEGTRVHELPTSSPGRDPGPRAAHVLSRKGPGSTSCPRPLQEG

TPGSRAAHALSRRGHRVHELPTSSPGGDTGFMSCPRPFQEGTPGSRAAHVLSRKGPRVHELPTSSPGR

DPGFTSCPRPLQEGTRVTNCPRPLQEGTPGSRAAHVLSRRGHRVHELPTPSPGRDPGFMSCPRPLQEG

TRVTNCPRPLQEGTRVTSCPRRLQEGTRVTSCPRPLQEGTRVTNCPRALQEGTPGSRAAHALSRKGPRV

HELPTSSPGGDTGFTSCPRPLQEGTPGSRAAHALSRRGHRVHELPTSSPGRDPGHELPTSSPGGDTGFT

SCPRTFQEGTPGSGLLPAHIVPLCKSEE (hMUC12)         SEQ ID NO: 40

MLVIWILTLALRLCASVTTVTPEGSAVHKAISQQGTLWTGEVLEKQTVEQGKSTLRRQKN

HFHRSAGELRCRNALKDEGASAGWSVMFAGESVVVLVHLWMTGARVKNLGLVEFASPGDD

GDGRAEGFSLGLPLSEQARAAGAREKERQETVINHSTFSGFSQITGSTVNTSIGGNTTSA

STPSSSDPFTTFSDYGVSVTFITGSTATKHFLDSSTNSGHSEESTVSHSGPGATGTTLFP

SHSATSVFVGEPKTSPITSASMETTALPGSTTTAGLSEKSTTFYSSPRSPDRTLSPARTT

SSGVSEKSTTSHSRPGPTHTIAFPDSTTMPGVSQESTASHSIPGSTDTTLSPGTTTPSSL

GPESTTFHSSPGYTKTTRLPDNTTTSGLLEASTPVHSSTGSPHTTLSPSSSTTHEGEPTT

FQSWPSSKDTSPAPSGTTSAFVKLSTTYHSSPSSTPTTHFSASSTTLGHSEESTPVHSSP

VATATTPPPARSATSGHVEESTAYHRSPGSTQTMHFPESSTTSGHSEESATFHGSTTHTK

SSTPSTTAALAHTSYHSSLGSTETTHFRDSSTISGRSEESKASHSSPDAMATTVLPAGST

PSVLVGDSTPSPISSGSMETTALPGSTTKPGLSEKSTTFYSSPRSPDTTHLPASMTSSGV

SEESTTSHSRPGSTHTTAFPGSTTMPGLSQESTASHSSPGPTDTTLSPGSTTASSLGPEY

TTFHSRPGSTETTLLPDNTTASGLLEASMPVHSSTRSPHTTLSPAGSTTRQGESTTFHSW

PSSKDTRPAPPTTTSAFVEPSTTSHGSPSSIPTTHISARSTTSGLVEESTTYHSSPGSTQ

TMHFPESDTTSGRGEESTTSHSSTTHTISSAPSTTSALVEEPTSYHSSPGSTATTHFPDS

STTSGRSEESTASHSSQDATGTIVLPARSTTSVLLGESTTSPISSGSMETTALPGSTTTP

GLSERSTTFHSSPRSPATTLSPASTTSSGVSEESTTSRSRPGSTHTTAFPDSTTTPGLSR

HSTTSHSSPGSTDTTLLPASTTTSGPSQESTTSHSSSGSTDTALSPGSTTALSFGQESTT

FHSNPGSTHTTLFPDSTTSSGIVEASTRVHSSTGSPRTTLSPASSTSPGLQGESTAFQTH

PASTHTTPSPPSTATAPVEESTTYHRSPGSTPTTHFPASSTTSGHSEKSTIFHSSPDASG

TTPSSAHSTTSGRGESTTSRISPGSTEITTLPGSTTTPGLSEASTTFYSSPRSPTTTLSP

ASMTSLGVGEESTTSRSQPGSTHSTVSPASTTTPGLSEESTTVYSSSRGSTETTVFPHST

TTSVHGEEPTTFHSRPASTHTTLFTEDSTTSGLTEESTAFPGSPASTQTGLPATLTTADL

GEESTTFPSSSGSTGTKLSPARSTTSGLVGESTPSRLSPSSTETTTLPGSPTTPSLSEKS

TTFYTSPRSPDATLSPATTTSSGVSEESSTSHSQPGSTHTTAFPDSTTTSDLSQEPTTSH

SSQGSTEATLSPGSTTASSLGQQSTTFHSSPGDTETTLLPDDTITSGLVEASTPTHSSTG

-continued

SLHTTLTPASSTSAGLQEESTTFQSWPSSSDTTPSPPGTTAAPVEVSTTYHSRPSSTPTT

HFSASSTTLGRSEESTTVHSSPGATGTALFPTRSATSVLVGEPTTSPISSGSTETTALPG

STTTAGLSEKSTTFYSSPRSPDTTLSPASTTSSGVSEESTTSHSRPGSTHTTAFPGSTTM

PGVSQESTASHSSPGSTDTTLSPGSTTASSLGPESTTFHSSPGSTETTLLPDNTTASGLL

EASTPVHSSTGSPHTTLSPAGSTTRQGESTTFQSWPSSKDTMPAPPTTTSAFVELSTTSH

GSPSSTPTTHFSASSTTLGRSEESTTVHSSPVATATTPSPARSTTSGLVEESTAYHSSPG

STQTMHFPESSTASGRSEESRTSHSSTTHTISSPPSTTSALVEEPTSYHSSPGSTATTHF

PDSSTTSGRSEESTASHSSQDATGTIVLPARSTTSVLLGESTTSPISSGSMETTALPGST

TTPGLSEKSTTFHSSPRSPATTLSPASTTSSGVSEESTTSHSRPGSTHTTAFPDSTTTPG

LSRHSTTSHSSPGSTDTTLLPASTTTSGPSQESTTSHSSPGSTDTALSPGSTTALSFGQE

STTFHSSPGSTHTTLFPDSTTSSGIVEASTRVHSSTGSPRTTLSPASSTSPGLQGESTAF

QTHPASTHTTPSPPSTATAPVEESTTYHRSPGSTPTTHFPASSTTSGHSEKSTIFHSSPD

ASGTTPSSAHSTTSGRGESTTSRISPGSTEITTLPGSTTTPGLSEASTTFYSSPRSPTTT

LSPASMTSLGVGEESTTSRSQPGSTHSTVSPASTTTPGLSEESTTVYSSSPGSTETTVFP

RTPTTSVRGEEPTTFHSRPASTHTTLFTEDSTTSGLTEESTAFPGSPASTQTGLPATLTT

ADLGEESTTFPSSSGSTGTTLSPARSTTSGLVGESTPSRLSPSSTETTTLPGSPTTPSLS

EKSTTFYTSPRSPDATLSPATTTSSGVSEESSTSHSQPGSTHTTAFPDSTTTPGLSRHST

TSHSSPGSTDTTLLPASTTTSGPSQESTTSHSSPGSTDTALSPGSTTALSFGQESTTFHS

SPGSTHTTLFPDSTTSSGIVEASTRVHSSTGSPRTTLSPASSTSPGLQGESTTFQTHPAS

THTTPSPPSTATAPVEESTTYHRSPGSTPTTHFPASSTTSGHSEKSTIFHSSPDASGTTP

SSAHSTTSGRGESTTSRISPGSTEITTLPGSTTTPGLSEASTTFYSSPRSPTTTLSPASM

TSLGVGEESTTSRSQPGSTHSTVSPASTTTPGLSEESTTVYSSSPGSTETTVFPRSTTTS

VRGEEPTTFHSRPASTHTTLFTEDSTTSGLTEESTAFPGSPASTQTGLPATLTTADLGEE

STTFPSSSGSTGTTLSPARSTTSGLVGESTPSRLSPSSTETTTLPGSPTTPSLSEKSTTF

YTSPRSPDATLSPATTTSSGVSEESSTSHSQPGSTHTTAFPDSTTTSGLSQEPTASHSSQ

GSTEATLSPGSTTASSLGQQSTTFHSSPGDTETTLLPDDTITSGLVEASTPHSSTGSLH

TTLTPASSTSAGLQEESTTFQSWPSSSDTTPSPPGTTAAPVEVSTTYHSRPSSTPTTHFS

ASSTTLGRSEESTTVHSSPGATGTALFPTRSATSVLVGEPTTSPISSGSTETTALPGSTT

TAGLSEKSTTFYSSPRSPDTTLSPASTTSSGVSEESTTSHSRPGSTHTTAFPGSTTMPGV

SQESTASHSSPGSTDTTLSPGSTTASSLGPESTTFHSGPGSTETTLLPDNTTASGLLEAS

TPVHSSTGSPHTTLSPAGSTTRQGESTTFQSWPNSKDTTPAPPTTTSAFVELSTTSHGSP

SSTPTTHFSASSTTLGRSEESTTVHSSPVATATTPSPARSTTSGLVEESTTYHSSPGSTQ

TMHFPESDTTSGRGEESTTSHSSTTHTISSAPSTTSALVEEPTSYHSSPGSTATTHFPDS

STTSGRSEESTASHSSQDATGTIVLPARSTTSVLLGESTTSPISSGSMETTALPGSTTTP

GLSEKSTTFHSSPRSPATTLSPASTTSSGVSEESTTSHSRPGSTHTTAFPDSTTTPGLSR

HSTTSHSSPGSTDTTLLPASTTTSGSSQESTTSHSSSGSTDTALSPGSTTALSFGQESTT

FHSSPGSTHTTLFPDSTTSSGIVEASTRVHSSTGSPRTTLSPASSTSPGLQGESTAFQTH

PASTHTTPSPPSTATAPVEESTTYHRSPGSTPTTHFPASSTTSGHSEKSTIFHSSPDASG

TTPSSAHSTTSGRGESTTSRISPGSTEITTLPGSTTTPGLSEASTTFYSSPRSPTTTLSP

ASMTSLGVGEESTTSRSQPGSTHSTVSPASTTTPGLSEESTTVYSSSPGSTETTVFPRST

TTSVRREEPTTFHSRPASTHTTLFTEDSTTSGLTEESTAFPGSPASTQTGLPATLTTADL

```
GEESTTFPSSSGSTGTKLSPARSTTSGLVGESTPSRLSPSSTETTTLPGSPTTPSLSEKS

TTFYTSPRSPDATLSPATTTSSGVSEESSTSHSQPGSTHTTAFPDSTTTSGLSQEPTTSH

SSQGSTEATLSPGSTTASSLGQQSTTFHSSPGDTETTLLPDDTITSGLVEASTPTHSSTG

SLHTTLTPASSTSTGLQEESTTFQSWPSSSDTTPSPPSTTAVPVEVSTTYHSRPSSTPTT

HFSASSTTLGRSEESTTVHSSPGATGTALFPTRSATSVLVGEPTTSPISSGSTETTALPG

STTTAGLSEKSTTFYSSPRSPDTTLSPASTTSSGVSEESTTSHSRPGSMHTTAFPSSTTM

PGVSQESTASHSSPGSTDTTLSPGSTTASSLGPESTTFHSSPGSTETTLLPDNTTASGLL

EASTPVHSSTGSPHTTLSPAGSTTRQGESTTFQSWPNSKDTTPAPPTTTSAFVELSTTSH

GSPSSTPTTHFSASSTTLGRSEESTTVHSSPVATATTPSPARSTTSGLVEESTTYHSSPG

STQTMHFPESNTTSGRGEESTTSHSSTTHTISSAPSTTSALVEEPTSYHSSPGSTATTHF

PDSSTTSGRSEESTASHSSQDATGTIVLPARSTTSVLLGESTTSPISSGSMETTALPGST

TTPGLSEKSTTFHSSPSSTPTTHFSASSTTLGRSEESTTVHSSPVATATTPSPARSTTSG

LVEESTAYHSSPGSTQTMHFPESSTASGRSEESRTSHSSTTHTISSPPSTTSALVEEPTS

YHSSPGSIATTHFPESSTTSGRSEESTASHSSPDTNGITPLPAHFTTSGRIAESTTFYIS

PGSMETTLASTATTPGLSAKSTILYSSSRSPDQTLSPASMTSSSISGEPTSLYSQAESTH

TTAFPASTTTSGLSQESTTFHSKPGSTETTLSPGSITTSSFAQEFTTPHSQPGSALSTVS

PASTTVPGLSEESTTFYSSPGSTETTAFSHSNTMSIHSQQSTPFPDSPGFTHTVLPATLT

TTDIGQESTAFHSSSDATGTTPLPARSTASDLVGEPTTFYISPSPTYTTLFPASSSTSGL

TEESTTFHTSPSFTSTIVSTESLETLAPGLCQEGQIWNGKQCVCPQGYVGYQCLSPLESF

PVETPEKLNATLGMTVKVTYRNFTEKMNDASSQEYQNFSTLFKNRMDVVLKGDNLPQYRG

VNIRRLLNGSIVVKNDVILEADYTLEYEELFENLAEIVKAKIMNETRTTLLDPDSCRKAI

LCYSEEDTFVDSSVTPGFDFQEQCTQKAAEGYTQFYYVDVLDGKLACVNKCTKGTKSQMN

CNLGTCQLQRSGPRCLCPNTNTHWYWGETCEFNIAKSLVYGIVGAVMAVLLLALIILIIL

FSLSQRKRHREQYDVPQEWRKEGTPGIFQKTAIWEDQNLRESRFGLENAYNNFRPTLETV

DSGTELHIQRPEMVASTV (hMUC13)
                                                    SEQ ID NO: 41
MKAIIHLTLLALLSVNTATNQGNSADAVTTTETATSGPTVAAADTTETNFPETASTTANTPSFPTATSPA

PPIISTHSSSTIPTPAPPIISTHSSSTIPIPTAADSESTTNVNSLATSDIITASSPNDGLITMVPSETQS

NNEMSPTTEDNQSSGPPTGTALLETSTLNSTGPSNPCQDDPCADNSLCVKLHNTSFCLCLEGYYYNSSTC

KKGKVFPGKISVTVSETFDPEEKHSMAYQDLHSEITSLFKDVFGTSVYGQTVILTVSTSLSPRSEMRADD

KFVNVTIVTILAETTSDNEKTVTEKINKAIRSSSSNFLNYDLTLRCDYYGCNQTADDCLNGLACDCKSDL

QRPNPQSPFCVASSLKCPDACNAQHKQCLIKKSGGAPECACVPGYQEDANGNCQKCAFGYSGLDCKDK

FQLILTIVGTIAGIVILSMIIALIVTARSNNKTKHIEEENLIDEDFQNLKLRSTGFTNLGAEGSVFPKVRIT

ASRDSQMQNPYSRHSSMPRPDY (hMUC14)
                                                    SEQ ID NO: 42
MELLQVTILFLLPSICSSNSTGVLEAANNSLVVTTTKPSITTPNTESLQKNVVTPTTGTTPKGTITNELL

KMSLMSTATFLTSKDEGLKATTTDVRKNDSIISNVTVTSVTLPNAVSTLQSSKPKTETQSSIKTTEIPGS
```

-continued

VLQPDASPSKTGTLTSIPVTIPENTSQSQVIGTEGGKNASTSATSRSYSSIILPVVIALIVITLSVFVLV

GLYRMCWKADPGTPENGNDQPQSDKESVKLLTVKTISHESGEHSAQGKTKN (hMUC15) SEQ ID NO: 43

MLALAKILLISTLFYSLLSGSHGKENQDINTTQNIAEVFKTMENKPISLESEANLNSDKE

NITTSNLKASHSPPLNLPNNSHGITDFSSNSSAEHSLGSLKPTSTISTSPPLIHSFVSKV

PWNAPIADEDLLPISAHPNATPALSSENFTVVSLVNDTVKTPDNSSITVSILSSEPTSPSV

TPLIVEPSGWLTTNSDSFTGFTPYQEKTTLQPTLKFTNNSKLFPNTSDPQKENRNTGIVF

GAILGAILGVSLLTLVGYLLCGKRKTDSFSHRRLYDDRNEPVLRLDNAPEPYDVSFGNSS

YYNPTLNDSAMPESEENARDGIPMDDIPPLRTSV (MUC16 Homo sapiens) SEQ ID NO: 44

MLKPSGLPGSSSPTRSLMTGSRSTKATPEMDSGLTGATLSPKTSTGAIVVTEHTLPFTSPDKTLASPTSS

VVGRTTQSLGVMSSALPESTSRGMTHSEQRTSPSLSPQVNGTPSRNYPATSMVSGLSSPRTRTSSTEGN

FTKEASTYTLTVETTSGPVTEKYTVPTETSTTEGDSTETPWDTRYIPVKITSPMKTFADSTASKENAPVSM

TPAETTVTDSHTPGRTNPSFGTLYSSFLDLSPKGTPNSRGETSLELILSTTGYPFSSPEPGSAGHSRIST

SAPLSSSASVLDNKISETSIFSGQSLTSPLSPGVPEARASTMPNSAIPFSMTLSNAETSAERVRSTISSL

GTPSISTKQTAETILTFHAFAETMDIPSTHIAKTLASEWLGSPGTLGGTSTSALTTTSPSTTLVSEETNT

HHSTSGKETEGTLNTSMTPLETSAPGEESEMTATLVPTLGFTTLDSKIRSPSQVSSSHPTRELRTTGSTS

GRQSSSTAAHGSSDILRATTSSTSKASSWTSESTAQQFSEPQHTQWVETSPSMKTERPPASTSVAAPITT

SVPSVVSGFTTLKTSSTKGIWLEETSADTLIGESTAGPTTHQFAVPTGISMTGGSSTRGSQGTTHLLTRA

TASSETSADLTLATNGVPVSVSPAVSKTAAGSSPPGGTKPSYTMVSSVIPETSSLQSSAFREGTSLGLTP

LNTRHPFSSPEPDSAGHTKISTSIPLLSSASVLEDKVSATSTFSHHKATSSITTGTPEISTKTKPSSAVL

SSMTLSNAATSPERVRNATSPLTHPSPSGEETAGSVLTLSTSAETTDSPNIHPTGTLTSESSESPSTLSL

PSVSGVKTTFSSSTPSTHLFTSGEETEETSNPSVSQPETSVSRVRTTLASTSVPTPVFPTMDTWPTRSAQ

FSSSHLVSELRATSSTSVTNSTGSALPKISHLTGTATMSQTNRDTFNDSAAPQSTTWPETSPRFKTGLPS

ATTTVSTSATSLSATVMVSKFTSPATSSMEATSIREPSTTILTTETTNGPGSMAVASTNIPIGKGYITEG

RLDTSHLPIGTTASSETSMDFTMAKESVSMSVSPSQSMDAAGSSTPGRTSQFVDTFSDDVYHLTSREITI

PRDGTSSALTPQMTATHPPSPDPGSARSTWLGILSSSPSSPTPKVTMSSTFSTQRVTTSMIMDTVETSRW

NMPNLPSTTSLTPSNIPTSGAIGKSTLVPLDTPSPATSLEASEGGLPTLSTYPESTNTPSIHLGAHASSE

SPSTIKLTMASVVKPGSYTPLTFPSIETHIHVSTARMAYSSGSSPEMTAPGETNTGSTWDPTTYITTTDP

KDTSSAQVSTPHSVRTLRTTENHPKTESATPAAYSGSPKISSSPNLTSPATKAWTITDTTEHSTQLHYTK

LAEKSSGFETQSAPGPVSVVIPTSPTIGSSTLELTSDVPGEPLVLAPSEQTTITLPMATWLSTSLTEEMA

STDLDISSPSSPMSTFAIFPPMSTPSHELSKSEADTSAIRNTDSTTLDQHLGIRSLGRTGDLTTVPITPL

TTTWTSVIEHSTQAQDTLSATMSPTHVTQSLKDQTSIPASASPSHLTEVYPELGTQGRSSSEATTFWKPS

TDTLSREIETGPTNIQSTPPMDNTTTGSSSSGVTLGIAHLPIGTSSPAETSTNMALERRSSTATVSMAGT

MGLLVTSAPGRSISQSLGRVSSVLSESTTEGVTDSSKGSSPRLNTQGNTALSSSLEPSYAEGSQMSTSIP

LTSSPTTPDVEFIGGSTFWTKEVTTVMTSDISKSSARTESSSATLMSTALGSTENTGKEKLRTASMDLPS

PTPSMEVTPWISLTLSNAPNTTDSLDLSHGVHTSSAGTLATDRSLNTGVTRASRLENGSDTSSKSLSMGN

STHTSMTDTEKSEVSSSIHPRPETSAPGAETTLTSTPGNRAISLTLPFSSIPVEEVISTGITSGPDINSA

PMTHSPITPPTIVWTSTGTIEQSTQPLHAVSSEKVSVQTQSTPYVNSVAVSASPTHENSVSSGSSTSSPY

SSASLESLDSTISRRNAITSWLWDLTTSLPTTTWPSTSLSEALSSGHSGVSNPSSTTTEFPLFSAASTSA

-continued

AKQRNPETETHGPQNTAASTLNTDASSVTGLSETPVGASISSEVPLPMAITSRSDVSGLTSESTANPSLG

TASSAGTKLTRTISLPTSESLVSFRMNKDPWTVSIPLGSHPTTNTETSIPVNSAGPPGLSTVASDVIDTP

SDGAESIPTVSFSPSPDTEVTTISHFPEKTTHSFRTISSLTHELTSRVTPIPGDWMSSAMSTKPTGASPS

ITLGERRTITSAAPTTSPIVLTASFTETSTVSLDNETTVKTSDILDARKTNELPSDSSSSSDLINTSIAS

STMDVTKTASISPTSISGMTASSSPSLFSSDRPQVPTSTTETNTATSPSVSSNTYSLDGGSNVGGTPSTL

PPFTITHPVETSSALLAWSRPVRTFSTMVSTDTASGENPTSSNSVVTSVPAPGTWASVGSTTDLPAMGFL

KTSPAGEAHSLLASTIEPATAFTPHLSAAVVTGSSATSEASLLTTSESKAIHSSPQTPTTPTSGANWETS

ATPESLLVVTETSDTTLTSKILVTDTILFSTVSTPPSKFPSTGTLSGASFPTLLPDTPAIPLTATEPTSS

LATSFDSTPLVTIASDSLGTVPETTLTMSETSNGDALVLKTVSNPDRSIPGITIQGVTESPLHPSSTSPS

KIVAPRNTTYEGSITVALSTLPAGTTGSLVFSQSSENSETTALVDSSAGLERASVMPLTTGSQGMASSGG

IRSGSTHSTGTKTFSSLPLTMNPGEVTAMSEITTNRLTATQSTAPKGIPVKPTSAESGLLTPVSASSSPS

KAFASLTTAPPSTWGIPQSTLTFEFSEVPSLDTKSASLPTPGQSLNTIPDSDASTASSSLSKSPEKNPRA

RMMTSTKAISASSFQSTGFTETPEGSASPSMAGHEPRVPTSGTGDPRYASESMSYPDPSKASSAMTSTS

LASKLTTLFSTGQAARSGSSSSPISLSTEKETSFLSPTASTSRKTSLFLGPSMARQPNILVHLQTSALTLS

PTSTLNMSQEEPPELTSSQTIAEEEGTTAETQTLTFTPSETPTSLLPVSSPTEPTARRKSSPETWASSIS

VPAKTSLVETTDGTLVTTIKMSSQAAQGNSTWPAPAEETGTSPAGTSPGSPEVSTTLKIMSSKEPSISPE

IRSTVRNSPWKTPETTVPMETTVEPVTLQSTALGSGSTSISHLPTGTTSPTKSPTENMLATERVSLSPSP

PEAWTNLYSGTPGGTRQSLATMSSVSLESPTARSITGTGQQSSPELVSKTTGMEFSMWHGSTGGTTGDT

HVSLSTSSNILEDPVTSPNSVSSLTDKSKHKTETVVVSTTAIPSTVLNNKIMAAEQQTSRSVDEAYSSTSSW

SDQTSGSDITLGASPDVTNTLYITSTAQTTSLVSLPSGDQGITSLTNPSGGKTSSASSVTSPSIGLETLR

ANVSAVKSDIAPTAGHLSQTSSPAEVSILDVTTAPTPGISTTITTMGTNSISTTTPNPEVGMSTMDSTPA

TERRTTSTEHPSTWSSTAASDSWTVTDMTSNLKVARSPGTISTMHTTSFLASSTELDSMSTPHGRITVIG

TSLVTPSSDASAVKTETSTSERTLSPSDTTASTPISTFSRVQRMSISVPDILSTSWTPSSTEAEDVPVSM

VSTDHASTKTDPNTPLSTFLFDSLSTLDWDTGRSLSSATATTSAPQGATTPQELTLETMISPATSQLPFS

IGHITSAVTPAAMARSSGVTFSRPDPTSKKAEQTSTQLPTTTSAHPGQVPRSAATTLDVIPHTAKTPDAT

FQRQGQTALTTEARATSDSWNEKEKSTPSAPWITEMMNSVSEDTIKEVTSSSSVLKDPEYAGHKLGIWDD

FIPKFGKAAHMRELPLLSPPQDKEAIHPSTNTVETTGWVTSSEHASHSTIPAHSASSKLTSPVVTTSTRE

QAIVSMSTTTWPESTRARTEPNSFLTIELRDVSPYMDTSSTTQTSIISSPGSTAITKGPRTEITSSKRIS

SSFLAQSMRSSDSPSEAITRLSNFPAMTESGGMILAMQTSPPGATSLSAPTLDTSATASWTGTPLATTQR

FTYSEKTTLFSKGPEDTSQPSPPSVEETSSSSSLVPIHATTSPSNILLTSQGHSPSSTPPVTSVFLSETS

GLGKTTDMSRISLEPGTSLPPNLSSTAGEALSTYEASRDTKAIHHSADTAVTNMEATSSEYSPIPGHTKP

SKATSPLVTSHIMGDITSSTSVFGSSETTEIETVSSVNQGLQERSTSQVASSATETSTVITHVSSGDATT

HVTKTQATFSSGTSISSPHQFITSTNTFTDVSTNPSTSLIMTESSGVTITTQTGPTGAATQGPYLLDTST

MPYLTETPLAVTPDFMQSEKTTLISKGPKDVTVVTSPPSVAETSYPSSLTPFLVTTIPPATSTLQGQHTSS

PVSATSVLTSGLVKTTDMLNTSMEPVTNSPQNLNNPSNEILATLAATTDIETIHPSINKAVTNMGTASSA

HVLHSTLPVSSEPSTATSPMVPASSMGDALASISIPGSETTDIEGEPTSSLTAGRKENSTLQEMNSTTES

NIILSNVSVGAITEATKMEVPSFDATFIPTPAQSTKFPDIFSVASSRLSNSPPMTISTHMTTTQTGSSGA

TSKIPLALDTSTLETSAGTPSVVTEGFAHSKITTAMNNDVKDVSQTNPPFQDEASSPSSQAPVLVTTLPS

SVAFTPQWHSTSSPVSMSSVLTSSLVKTAGKVDTSLETVTSSPQSMSNTLDDISVTSAATTDIETTHPSI

NTVVTNVGTTGSAFESHSTVSAYPEPSKVTSPNVTTSTMEDTTISRSIPKSSKTTRTETETTSSLTPKLR

ETSISQEITSSTETSTVPYKELTGATTEVSRTDVTSSSSTSFPGPDQSTVSLDISTETNTRLSTSPIMTE

```
SAEITITTQTGPHGATSQDTFTMDPSNTTPQAGIHSAMTHGFSQLDVTTLMSRIPQDVSWTSPPSVDKTS

SPSSFLSSPAMTTPSLISSTLPEDKLSSPMTSLLTSGLVKITDILRTRLEPVTSSLPNFSSTSDKILATS

KDSKDTKEIFPSINTEETNVKANNSGHESHSPALADSETPKATTQMVITTTVGDPAPSTSMPVHGSSETT

NIKREPTYFLTPRLRETSTSQESSFPTDTSFLLSKVPTGTITEVSSTGVNSSSKISTPDHDKSTVPPDTF

TGEIPRVFTSSIKTKSAEMTITTQASPPESASHSTLPLDTSTTLSQGGTHSTVTQGFPYSEVTTLMGMGP

GNVSWMTTPPVEETSSVSSLMSSPAMTSPSPVSSTSPQSIPSSPLPVTALPTSVLVTTTDVLGTTSPESV

TSSPPNLSSITHERPATYKDTAHTEAAMHHSTNTAVTNVGTSGSGHKSQSSVLADSETSKATPLMSTTST

LGDTSVSTSTPNISQTNQIQTEPTASLSPRLRESSTSEKTSSTTETNTAFSYVPTGAITQASRTEISSSR

TSISDLDRPTIAPDISTGMITRLFTSPIMTKSAEMTVTTQTTTPGATSQGILPWDTSTTLFQGGTHSTVS

QGFPHSEITTLRSRTPGDVSWMTTPPVEETSSGFSLMSPSMTSPSPVSSTSPESIPSSPLPVTALLTSVL

VTTTNVLGTTSPETVTSSPPNLSSPTQERLTTYKDTAHTEAMHASMHTNTAVANVGTSISGHESQSSVPA

DSHTSKATSPMGITFAMGDTSVSTSTPAFFETRIQTESTSSLIPGLRDTRTSEEINTVTETSTVLSEVPT

TTTTEVSRTEVITSSRTTISGPDHSKMSPYISTETITRLSTFPFVTGSTEMAITNQTGPIGTISQATLTL

DTSSTASWEGTHSPVTQRFPHSEETTTMSRSTKGVSWQSPPSVEETSSPSSPVPLPAITSHSSLYSAVSG

SSPTSALPVTSLLTSGRRKTIDMLDTHSELVTSSLPSASSFSGEILTSEASTNTETIHFSENTAETNMGT

TNSMHKLHSSVSIHSQPSGHTPPKVTGSMMEDAIVSTSTPGSPETKNVDRDSTSPLTPELKEDSTALVMN

STTESNTVFSSVSLDAATEVSRAEVTYYDPTFMPASAQSTKSPDISPEASSSHSNSPPLTISTHKTIATQ

TGPSGVTSLGQLTLDTSTIATSAGTPSARTQDFVDSETTSVMNNDLNDVLKTSPFSAEEANSLSSQAPLL

VTTSPSPVTSTLQEHSTSSLVSVTSVPTPTLAKITDMDTNLEPVTRSPQNLRNTLATSEATTDTHTMHPS

INTAMANVGTTSSPNEFYFTVSPDSDPYKATSAVVITSTSGDSIVSTSMPRSSAMKKIESETTFSLIFRL

RETSTSQKIGSSSDTSTVFDKAFTAATTEVSRTELTSSSRTSIQGTEKPTMSPDTSTRSVTMLSTFAGLT

KSEERTIATQTGPHRATSQGTLTWDTSITTSQAGTHSAMTHGFSQLDLSTLTSRVPEYISGTSPPSVEKT

SSSSSLLSLPAITSPSPVPTTLPESRPSSPVHLTSLPTSGLVKTTDMLASVASLPPNLGSTSHKIPTTSE

DIKDTEKMYPSTNIAVTNVGTTTSEKESYSSVPAYSEPPKVTSPMVTSFNIRDTIVSTSMPGSSEITRIE

MESTFSVAHGLKGTSTSQDPIVSTEKSAVLHKLTTGATETSRTEVASSRRTSIPGPDHSTESPDISTEVI

PSLPISLGITESSNMTIITRTGPPLGSTSQGTFTLDTPTTSSRAGTHSMATQEFPHSEMTTVMNKDPEIL

SWTIPPSIEKTSFSSSLMPSPAMTSPPVSSTLPKTIHTTPSPMTSLLTPSLVMTTDTLGTSPEPTTSSPP

NLSSTSHVILTTDEDTTAIEAMHPSTSTAATNVETTCSGHGSQSSVLTDSEKTKATAPMDTTSTMGHTTV

STSMSVSSETTKIKRESTYSLTPGLRETSISQNASFSTDTSIVLSEVPTGTTAEVSRTEVTSSGRTSIPG

PSQSTVLPEISTRTMTRLFASPTMTESAEMTIPTQTGPSGSTSQDTLTLDTSTTKSQAKTHSTLTQRFPH

SEMTTLMSRGPGDMSWQSSPSLENPSSLPSLLSLPATTSPPPISSTLPVTISSSPLPVTSLLTSSPVTTT

DMLHTSPELVTSSPPKLSHTSDERLTTGKDTTNTEAVHPSTNTAASNVEIPSFGHESPSSALADSETSKA

TSPMFITSTQEDTTVAISTPHFLETSRIQKESISSLSPKLRETGSSVETSSAIETSAVLSEVSIGATTEI

SRTEVTSSSRTSISGSAESTMLPEISTTRKIIKFPTSPILAESSEMTIKTQTSPPGSTSESTFTLDTSTT

PSLVITHSTMTQRLPHSEITTLVSRGAGDVPRPSSLPVEETSPPSSQLSLSAMISPSPVSSTLPASSHSS

SASVTSPLTPGQVKTTEVLDASAEPETSSPPSLSSTSVEILATSEVTTDTEKIHPFPNTAVTKVGTSSSG

HESPSSVLPDSETTKATSAMGTISIMGDTSVSTLTPALSNTRKIQSEPASSLTTRLRETSTSEETSLATE

ANTVLSKVSTGATTEVSRTEAISFSRTSMSGPEQSTMSQDISIGTIPRISASSVLTESAKMTITTQTGPS

ESTLESTLNLNTATTPSWVETHSIVIQGFPHPEMTTSMGRGPGGVSWPSPPFVKETSPPSSPLSLPAVTS

PHPVSTTFLAHIPPSPLPVTSLLTSGPATTTDILGTSTEPGTSSSSSLSTTSHERLTTYKDTAHTEAVHP
```

-continued

STNTGGTNVATTSSGYKSQSSVLADSSPMCTTSTMGDTSVLTSTPAFLETRRIQTELASSLTPGLRESSG

SEGTSSSGTKMSTVLSKVPTGATTEISKEDVTSIPGPAQSTISPDISTRTVSWFSTSPVMTESAEITMNTH

TSPLGATTQGTSTLATSSTTSLTMTHSTISQGFSHSQMSTLMRRGPEDVSWMSPPLLEKTRPSFSLMSSP

ATTSPSPVSSTLPESISSSPLPVTSLLTSGLAKTTDMLHKSSEPVTNSPANLSSTSVEILATSEVTTDTE

KTHPSSNRTVTDVGTSSSGHESTSFVLADSQTSKVTSPMVITSTMEDTSVSTSTPGFFETSRIQTEPTSS

LTLGLRKTSSSEGTSLATEMSTVLSGVPTGATAEVSRTEVTSSSRTSISGFAQLTVSPETSTETITRLPT

SSIMTESAEMMIKTQTDPPGSTPESTHTVDISTTPNWVETHSTVTQRFSHSEMTTLVSRSPGDMLWPSQS

SVEETSSASSLLSLPATTSPSPVSSTLVEDFPSASLPVTSLLTPGLVITTDRMGISREPGTSSTSNLSST

SHERLTTLEDTVDTEDMQPSTHTAVTNVRTSISGHESQSSVLSDSETPKATSPMGTTYTMGETSVSISTS

DFFETSRIQIEPTSSLTSGLRETSSSERISSATEGSTVLSEVPSGATTEVSRTEVISSRGTSMSGPDQFT

ISPDISTEAITRLSTSPIMTESAESAITIETGSPGATSEGTLTLDTSTTTFWSGTHSTASPGFSHSEMTT

LMSRTPGDVPWPSLPSVEEASSVSSSLSSPAMTSTSFFSALPESISSSPHPVTALLTLGPVKTTDMLRTS

SEPETSSPPNLSSTSAEILATSEVTKDREKIHPSSNTPVVNVGTVIYKHLSPSSVLADLVTTKPTSPMAT

TSTLGNTSVSTSTPAFPETMMTQPTSSLTSGLREISTSQETSSATERSASLSGMPTGATTKVSRTEALSL

GRTSTPGPAQSTISPEISTETITRISTPLTTTGSAEMTITPKTGHSGASSQGTFTLDTSSRASWPGTHSA

ATHRSPHSGMTTPMSRGPEDVSWPSRPSVEKTSPPSSLVSLSAVTSPSPLYSTPSESSHSSPLRVTSLFT

PVMMKTTDMLDTSLEPVTTSPPSMNITSDESLATSKATMETEAIQLSENTAVTQMGTISARQEFYSSYPG

LPEPSKVTSPVVTSSTIKDIVSTTIPASSEITRIEMESTSTLTPTPRETSTSQEIHSATKPSTVPYKALT

SATIEDSMTQVMSSSRGPSPDQSTMSQDISSEVITRLSTSPIKAESTEMTITTQTGSPGATSRGTLTLDT

STTFMSGTHSTASQGFSHSQMTALMSRTPGDVPWLSHPSVEEASSASFSLSSPVMTSSSPVSSTLPDSIH

SSSLPVTSLLTSGLVKTTELLGTSSEPETSSPPNLSSTSAEILATTEVTTDTEKLEMTNVVTSGYTHESP

SSVLADSVTTKATSSMGITYPTGDTNVLTSTPAFSDTSRIQTKSKLSLTPGLMETSISEETSSATEKSTV

LSSVPTGATTEVSRTEAISSSRTSIPGPAQSTMSSDTSMETITRISTPLTRKESTDMAITPKTGPSGATS

QGTFTLDSSSTASWPGTHSATTQRFPQSVVTTPMSRGPEDVSWPSPLSVEKNSPPSSLVSSSSVTSPSP

LYSTPSGSSHSSPVPVTSLFTSIMMKATDMLDASLEPETTSAPNMNITSDESLATSKATTETEAIHVFENT

AASHVETTSATEELYSSSPGFSEPTKVISPVVTSSSIRDNMVSTTMPGSSGITRIEIESMSSLTPGLRET

RTSQDITSSTETSTVLYKMSSGATPEVSRTEVMPSSRTSIPGPAQSTMSLDISDEVVTRLSTSPIMTESA

EITITTQTGYSLATSQVTLPLGTSMTFLSGTHSTMSQGLSHSEMTNLMSRGPESLSWTSPRFVETTRSSS

SLTSLPLTTSLSPVSSTLLDSSPSSPLPVTSLILPGLVKTTEVLDTSSEPKTSSSPNLSSTSVEIPATSE

IMTDTEKIHPSSNTAVAKVRTSSSVHESHSSVLADSETTITIPSMGITSAVDDTTVFTSNPAFSETRRIP

TEPTFSLTPGFRETSTSEETTSITETSAVLYGVPTSATTEVSMTEIMSSNRTHIPDSDQSTMSPDIITEV

ITRLSSSSMMSESTQMTITTQKSSPGATAQSTLTLATTTAPLARTHSTVPPRFLHSEMTTLMSRSPENPS

WKSSPFVEKTSSSSSLLSLPVTTSPSVSSTLPQSIPSSSFSVTSLLTPGMVKTTDTSTEPGTSLSPNLSG

TSVEILAASEVTTDTEKIHPSSSMAVTNVGTTSSGHELYSSVSIHSEPSKATYPVGTPSSMAETSISTSM

PANFETTGFEAEPFSHLTSGFRKTNMSLDTSSVTPTNTPSSPGSTHLLQSSKTDFTSSAKTSSPDWPPAS

QYTEIPVDIITPFNASPSITESTGITSFPESRFTMSVTESTHHLSTDLLPSAETISTGTVMPSLSEAMTS

FATTGVPRAISGSGSPFSRTESGPGDATLSTIAESLPSSTPVPFSSSTFTTTDSSTIPALHEITSSSATP

YRVDTSLGTESSTTEGRLVMVSTLDTSSQPGRTSSTPILDTRMTESVELGTVTSAYQVPSLSTRLTRTDG

IMEHITKIPNEAAHRGTIRPVKGPQTSTSPASPKGLHTGGTKRMETTTTALKTTTTALKTTSRATLTTSV

YTPTLGTLTPLNASRQMASTILTEMMITTPYVFPDVPETTSSLATSLGAETSTALPRTTPSVLNRESETT

ASLVSRSGAERSPVIQTLDVSSSEPDTTASWVIHPAETIPTVSKTTPNFFHSELDTVSSTATSHGADVSS

-continued

```
AIPTNISPSELDALTPLVTISGTDTSTTFPTLTKSPHETETRTTWLTHPAETSSTIPRTIPNFSHHESDA
TPSIATSPGAETSSAIPIMTVSPGAEDLVTSQVTSSGTDRNMTIPTLTLSPGEPKTIASLVTHPEAQTSS
AIPTSTISPAVSRLVTSMVTSLAAKTSTTNRALTNSPGEPATTVSLVTHPAQTSPTVPWTTSIFFHSKSD
TTPSMTTSHGAESSSAVPTPTVSTEVPGVVTPLVTSSRAVISTTIPILTLSPGEPETTPSMATSHGEEAS
SAIPTPTVSPGVPGVVTSLVTSSRAVTSTTIPILTFSLGEPETTPSMATSHGTEAGSAVPTVLPEVPGMV
TSLVASSRAVTSTTLPTLTLSPGEPETTPSMATSHGAEASSTVPTVSPEVPGVVTSLVTSSSGVNSTSIP
TLILSPGELETTPSMATSHGAEASSAVPTPTVSPGVSGVVTPLVTSSRAVTSTTIPILTLSSSEPETTPS
MATSHGVEASSAVLTVSPEVPGMVTSLVTSSRAVTSTTIPTLTISSDEPETTTSLVTHSEAKMISAIPTL
AVSPTVQGLVTSLVTSSGSETSAFSNLTVASSQPETIDSWVAHPGTEASSVVPTLTVSTGEPFTNISLVT
HPAESSSTLPRTTSRFSHSELDTMPSTVTSPEAESSSAISTTISPGIPGVLTSLVTSSGRDISATFPTVP
ESPHESEATASWVTHPAVTSTTVPRTTPNYSHSEPDTTPSIATSPGAEATSDFPTITVSPDVPDMVTSQV
TSSGTDTSITIPTLTLSSGEPETTTSFITYSETHTSSAIPTLPVSPGASKMLTSLVISSGTDSTTTFPTL
TETPYEPETTAIQLIHPAETNTMVPKTTPKFSHSKSDTTLPVAITSPGPEASSAVSTTTISPDMSDLVTS
LVPSSGTDTSTTFPTLSETPYEPETTVTWLTHPAETSTTVSGTIPNFSHRGSDTAPSMVTSPGVDTRSGV
PTTTIPPSIPGVVTSQVTSSATDTSTAIPTLTPSPGEPETTASSATHPGTQTGFTVPIRTVPSSEPDTMA
SWVTHPPQTSTPVSRTTSSFSHSSPDATPVMATSPRTEASSAVLTTISPGAPEMVTSQITSSGAATSTTV
PTLTHSPGMPETTALLSTHPRTGTSKTFPASTVFPQVSETTASLTIRPGAETSTALPTQTTSSLFTLLVT
GTSRVDLSPTASPGVSAKTAPLSTHPGTETSTMIPTSTLSLGLLETTGLLATSSSAETSTSTLTLTVSPA
VSGLSSASITTDKPQTVTSWNTETSPSVTSVGPPEFSRTVTGTTMTLIPSEMPTPPKTSHGEGVSPTTIL
RTTMVEATNLATTGSSPTVAKTTTTFNTLAGSLFTPLTTPGMSTLASESVTSRTSYNHRSWISTTSSYNR
RYWTPATSTPVTSTFSPGISTSSIPSSTAATVPFMVPFTLNFTITNLQYEEDMRHPGSRKFNATERELQG
LLKPLFRNSSLEYLYSGCRLASLRPEKDSSAMAVDAICTHRPDPEDLGLDRERLYWELSNLTNGIQELGP
YTLDRNSLYVNGFTHRSSMPTTSTPGTSTVDVGTSGTPSSSPSPTAAGPLLMPFTLNFTITNLQYEEDMR
RTGSRKFNTMESVLQGLLKPLFKNTSVGPLYSGCRLTLLRPEKDGAATGVDAICTHRLDPKSPGLNREQL
YWELSKLTNDIEELGPYTLDRNSLYVNGFTHQSSVSTTSTPGTSTVDLRTSGTPSSLSSPTIMAAGPLLV
PFTLNFTITNLQYEDMGHPGSRKFNTTERVLQGLLGPIFKNTSVGPLYSGCRLTSLRSEKDGAATGVDA
ICIHHLDPKSPGLNRERLYWELSQLTNGIKELGPYTLDRNSLYVNGFTHRTSVPTTSTPGTSTVDLGTSG
TPFSLPSPATAGPLLVLFTLNFTITNLKYEEDMHRPGSRKFNTTERVLQTLLGPMFKNTSVGLLYSGCRL
TLLRSEKDGAATGVDAICTHRLDPKSPGLDREQLYWELSQLTNGIKELGPYTLDRNSLYVNGFTHWIPVP
TSSTPGTSTVDLGSGTPSSLPSPTAAGPLLVPFTLNFTITNLQYEEDMHHPGSRKFNTTERVLQGLLGPM
FKNTSVGLLYSGCRLTLLRSEKDGAATGVDAICTHRLDPKSPGVDREQLYWELSQLTNGIKELGPYTLDR
NSLYVNGFTHQTSAPNTSTPGTSTVDLGTSGTPSSLPSPTSAGPLLVPFTLNFTITNLQYEEDMRHPGSR
KFNTTERVLQGLLKPLFKSTSVGPLYSGCRLTLLRSEKDGAATGVDAICTHRLDPKSPGVDREQLYWELS
QLTNGIKELGPYTLDRNSLYVNGFTHQTSAPNTSTPGTSTVDLGTSGTPSSLPSPTSAGPLLVPFTLNFT
ITNLQYEEDMHHPGSRKFNTTERVLQGLLGPMFKNTSVGLLYSGCRLTLLRPEKNGAATGMDAICSHRLD
PKSPGLNREQLYWELSQLTHGIKELGPYTLDRNSLYVNGFTHRSSVAPTSTPGTSTVDLGTSGTPSSLPS
PTTAVPLLVPFTLNFTITNLQYGEDMRHPGSRKFNTTERVLQGLLGPLFKNSSVGPLYSGCRLISLRSEK
DGAATGVDAICTHHLNPQSPGLDREQLYWQLSQMTNGIKELGPYTLDRNSLYVNGFTHRSSGLTTSTPWT
STVDLGTSGTPSPVPSPTTAGPLLVPFTLNFTITNLQYEEDMRHPGSRKFNTTERVLQGLLSPIFKNSSV
GPLYSGCRLTSLRPEKDGAATGMDAVCLYHPNPKRPGLDREQLYWELSQLTHNITELGPYSLDRDSLYVN
```

-continued

GFTHQNSVPTTSTPGTSTVYWATTGTPSSFPGHTEPGPLLIPFTFNFTITNLHYEENMQHPGSRKFNTTE
RVLQGLLKPLFKNTSVGPLYSGCRLTSLRPEKDGAATGMDAVCLYHPNPKRPGLDREQLYWELSQLTHNI
TELGPYSLDRDSLYVNGFTHQNSVPTTSTPGTSTVYWATTGTPSSFPGHTEPGPLLIPFTFNFTITNLHY
EENMQHPGSRKFNTTERVLQGLLKPLFKNTSVGPLYSGCRLTLLRPEKHEAATGVDTICTHRVDPIGPGL
DRERLYWELSQLTNSITELGPYTLDRDSLYVNGFNPRSSVPTTSTPGTSTVHLATSGTPSSLPGHTAPVP
LLIPFTLNFTITNLHYEENMQHPGSRKFNTTERVLQGLLKPLFKNTSVGPLYSGCRLTLLRPEKHEAATG
VDTICTHRVDPIGPGLXXEXLYWELSXLTXXIXELGPYTLDRXSLYVNGFTHXXSXPTTSTPGTSTVXXG
TSGTPSSXPXXTSAGPLLVPFTLNFTITNLQYEEDMHHPGSRKFNTTERVLQGLLGPMFKNTSVGLLYSG
CRLTLLRPEKNGAATGMDAICSHRLDPKSPGLDREQLYWELSQLTHGIKELGPYTLDRNSLYVNGFTHRS
SVAPTSTPGTSTVDLGTSGTPSSLPSPTTAVPLLVPFTLNFTITNLQYEDMRHPGSRKFNTTERVLQGL
LGPLFKNSSVGPLYSGCRLISLRSEKDGAATGVDAICTHHLNPQSPGLDREQLYWQLSQMTNGIKELGPY
TLDRNSLYVNGFTHRSSGLTTSTPWTSTVDLGTSGTPSPVPSPTTAGPLLVPFTLNFTITNLQYEEDMHR
PGSRKFNATERVLQGLLSPIFKNSSVGPLYSGCRLTSLRPEKDGAATGMDAVCLYHPNPKRPGLDREQLY
WELSQLTHNITELGPYSLDRDSLYVNGFTHQSSMTTTRTPDTSTMHLATSRTPASLSGPTTASPLLVLFT
INCTITNLQYEEDMRRTGSRKFNTMESVLQGLLKPLFKNTSVGPLYSGCRLTLLRPKKDGAATGVDAICT
HRLDPKSPGLNREQLYWELSKLTNDIEELGPYTLDRNSLYVNGFTHQSSVSTTSTPGTSTVDLRTSGTPS
SLSSPTIMXXXPLLXPFTXNXTITNLXXXXXXMXXPGSRKFNTTERVLQGLLRPLFKNTSVSSLYSGCRLT
LLRPEKDGAATRVDAACTYRPDPKSPGLDREQLYWELSQLTHSITELGPYTLDRVSLYVNGFNPRSSVPT
TSTPGTSTVHLATSGTPSSLPGHTXXXPLLXPFTXNXTITNLXXXXXXMXXPGSRKFNTTERVLQGLLKPL
FRNSSLEYLYSGCRLASLRPEKDSSAMAVDAICTHRPDPEDLGLDRERLYWELSNLTNGIQELGPYTLDR
NSLYVNGFTHRSSGLTTSTPWTSTVDLGTSGTPSPVPSPTTAGPLLVPFTLNFTITNLQYEEDMHRPGSR
RFNTTERVLQGLLTPLFKNTSVGPLYSGCRLTLLRPEKQEAATGVDTICTHRVDPIGPGLDRERLYWELS
QLTNSITELGPYTLDRDSLYVNGFNPWSSVPTTSTPGTSTVHLATSGTPSSLPGHTAPVPLLIPFTLNFT
ITDLHYEENMQHPGSRKFNTTERVLQGLLKPLFKSTSVGPLYSGCRLTLLRPEKHGAATGVDAICTLRLD
PTGPGLDRERLYWELSQLTNSVTELGPYTLDRDSLYVNGFTHRSSVPTTSIPGTSAVHLETSGTPASLPG
HTAPGPLLVPFTLNFTITNLQYEEDMRHPGSRKFSTTERVLQGLLKPLFKNTSVSSLYSGCRLTLLRPEK
DGAATRVDAVCTHRPDPKSPGLDRERLYWKLSQLTHGITELGPYTLDRHSLYVNGFTHQSSMTTTRTPDT
STMHLATSRTPASLSGPTTASPLLVLFTINFTITNLRYEENMHHPGSRKFNTTERVLQGLLRPVFKNTSV
GPLYSGCRLTTLRPKKDGAATKVDAICTYRPDPKSPGLDREQLYWELSQLTHSITELGPYTQDRDSLYVN
GFTHRSSVPTTSIPGTSAVHLETSGTPASLPGHTAPGPLLVPFTLNFTITNLQYEEDMRHPGSRKFNTTE
RVLQGLLKPLFKSTSVGPLYSGCRLTLLRPEKRGAATGVDTICTHRLDPLNPGLDREQLYWELSKLTRGI
IELGPYLLDRGSLYVNGFTHRTSVPTTSTPGTSTVDLGTSGTPFSLPSPAXXXPLLXPFTXNXTITNLXX
XXXMXXPGSRKFNTTERVLQTLLGPMFKNTSVGLLYSGCRLTLLRSEKDGAATGVDAICTHRLDPKSPGV
DREQLYWELSQLTNGIKELGPYTLDRNSLYVNGFTHWIPVPTSSTPGTSTVDLGSGTPSSLPSPTTAGPL
LVPFTLNFTITNLKYEEDMHCPGSRKFNTTERVLQSLLGPMFKNTSVGPLYSGCRLTLLRSEKDGAATGV
DAICTHRLDPKSPGVDREQLYWELSQLTNGIKELGPYTLDRNSLYVNGFTHQTSAPNTSTPGTSTVDLGT
SGTPSSLPSPTXXXPLLXPFTXNXTITNLXXXXXXMXXPGSRKFNTTEXVLQGLLXPFKNXSVGXLYSGC
RLTXLRXEKXGAATGXDAICXHXXXPKXPGLXXEXLYWELSXLTXXIXELGPYTLDRXSLYVNGFTHWIP
VPTSSTPGTSTVDLGSGTPSSLPSPTTAGPLLVPFTLNFTITNLKYEEDMHCPGSRKFNTTERVLQSLLG
PMFKNTSVGPLYSGCRLTSLRSEKDGAATGVDAICTHRVDPKSPGVDREQLYWELSQLTNGIKEL

-continued

SRKFNTTERVLQGLLGPMFKNTSVGLLYSGCRLTLLRPEKNGATTGMDAICTHRLDPKSPGLXXEXLYWE
LSXLTXXIXELGPYTLDRXSLYVNGFTHXXSXPTTSTPGTSTVXXGTSGTPSSXPXXTXXXPLLXPFTXN
XTITNLXXXXXMXXPGSRKFNTTERVLQGLLKPLFRNSSLEYLYSGCRLASLRPEKDSSAMAVDAICTHR
PDPEDLGLDRERLYWELSNLTNGIQELGPYTLDRNSLYVNGFTHRSSMPTTSTPGTSTVDVGTSGTPSSS
PSPTTAGPLLIPFTLNFTITNLQYGEDMGHPGSRKFNTTERVLQGLLGPIFKNTSVGPLYSGCRLTSLRS
EKDGAATGVDAICIHHLDPKSPGLNRERLYWELSQLTNGIKELGPYTLDRNSLYVNGFTHRTSVPTTSTP
GTSTVDLGTSGTPFSLPSPATAGPLLVLFTLNFTITNLKYEEDMHRPGSRKFNTTERVLQTLLGPMFKNT
SVGLLYSGCRLTLLRSEKDGAATGVDAICTHRLDPKSPGLXXEXLYWELSXLTXXIXELGPYTLDRXSLY
VNGFTHXXSXPTTSTPGTSTVXXGTSGTPSSXPXXTXXXPLLXPFTXNXTITNLXXXXXMXXPGSRKFNT
TERVLQGLLRPVFKNTSVGPLYSGCRLTLLRPKKDGAATKVDAICTYRPDPKSPGLDREQLYWELSQLTH
SITELGPYTQDRDSLYVNGFTHRSSVPTTSIPGTSAVHLETTGTPSSFPGHTEPGPLLIPFTFNFTITNL
RYEENMQHPGSRKFNTTERVLQGLLTPLFKNTSVGPLYSGCRLTLLRPEKQEAATGVDTICTHRVDPIGP
GLDRERLYWELSQLTNSITELGPYTLDRDSLYVDGFNPWSSVPTTSTPGTSTVHLATSGTPSPLPGHTAP
VPLLIPFTLNFTITDLHYEENMQHPGSRKFNTTERVLQGLLKPLFKSTSVGPLYSGCRLTLLRPEKHGAA
TGVDAICTLRLDPTGPGLDRERLYWELSQLTNSITELGPYTLDRDSLYVNGFNPWSSVPTTSTPGTSTVH
LATSGTPSSLPGHTTAGPLLVPFTLNFTITNLKYEEDMHCPGSRKFNTTERVLQSLHGPMFKNTSVGPLY

SGCRLTLLRSEKDGAATGVDAICTHRLDPKSPGLXXEXLYWELSXLTXXIXELGPYTLDRXSLYVNGFTH

XXSXPTTSTPGTSTVXXGTSGTPSSXPXXTXXXPLLXPFTXNXTITNLXXXXXMXXPGSRKFNTTEXVLQ

GLLXPXFKNXSVGXLYSGCRLTXLRXEKXGAATGXDAICXHXXXPKXPGLXXEXLYWELSXLTNSITELG

PYTLDRDSLYVNGFTHRSSMPTTSIPGTSAVHLETSGTPASLPGHTAPGPLLVPFTLNFTITNLQYEEDM

RHPGSRKFNTTERVLQGLLKPLFKSTSVGPLYSGCRLTLLRPEKRGAATGVDTICTHRLDPLNPGLXXEX

LYWELSXLTXXIXELGPYTLDRXSLYVNGFTHXXSXPTTSTPGTSTVXXGTSGTPSSXPXXTXXXPLLXP

FTXNXTITNLXXXXXMXXPGSRKFNTTEXVLQGLLXPXFKNXSVGXLYSGCRLTXLRXEKXGAATGXDAI

CXHXXXPKXPGLXXEXLYWELSXLTXXIXELGPYTLDRXSLYVNGFHPRSSVPTTSTPGTSTVHLATSGT

PSSLPGHTAPVPLLIPFTLNFTITNLHYEENMQHPGSRKFNTTERVLQGLLGPMFKNTSVGLLYSGCRLT

LLRPEKNGAATGMDAICSHRLDPKSPGLXXEXLYWELSXLTXXIXELGPYTLDRXSLYVNGFTHXXSXPT

TSTPGTSTVXXGTSGTPSSXPXXTXXXPLLXPFTXNXTITNLXXXXXMXXPGSRKFNTTEXVLQGLLXPX

FKNXSVGXLYSGCRLTXLRXEKXGAATGXDAICXHXXXPKXPGLXXEXLYWELSXLTXXIXELGPYTLDR

XSLYVNGFTHQNSVPTTSTPGTSTVYWATTGTPSSFPGHTEPGPLLIPFTFNFTITNLHYEENMQHPGSR

KFNTTERVLQGLLTPLFKNTSVGPLYSGCRLTLLRPEKQEAATGVDTICTHRVDPIGPGLXXEXLYWELS

XLTXXIXELGPYTLDRXSLYVNGFTHXXSXPTTSTPGTSTVXXGTSGTPSSXPXXTXXXPLLXPFTXNXT

ITNLXXXXXMXXPGSRKFNTTEXVLQGLLXPXFKNXSVGXLYSGCRLTXLRXEKXGAATGXDAICXHXXX

PKXPGLXXEXLYWELSXLTXXIXELGPYTLDRXSLYVNGFTHRSSVPTTSSPGTSTVHLATSGTPSSLPG

HTAPVPLLIPFTLNFTITNLHYEENMQHPGSRKFNTTERVLQGLLKPLFKSTSVGPLYSGCRLTLLRPEK

HGAATGVDAICTLRLDPTGPGLXXEXLYWELSXLTXXIXELGPYTLDRXSLYVNGFTHXXSXPTTSTPGT

STVXXGTSGTPSSXPXXTXXXPLLXPFTXNXTITNLXXXXXMXXPGSRKFNTTEXVLQGLLXPXFKNXSV

GXLYSGCRLTXLRXEKXGAATGXDAICXHXXXPKXPGLXXEXLYWELSXLTXXIXELGPYTLDRXSLYVN

GFTHRTSVPTTSTPGTSTVHLATSGTPSSLPGHTAPVPLLIPFTLNFTITNLQYEEDMHRPGSRKFNTTE

RVLQGLLSPIFKNSSVGPLYSGCRLTSLRPEKDGAATGMDAVCLYHPNPKRPGLDREQLYCELSQLTHNI

TELGPYSLDRDSLYVNGFTHQNSVPTTSTPGTSTVYWATTGTPSSFPGHTXXXPLLXPFTXNXTITNLXX

-continued

XXXMXXPGSRKFNTTEXVLQGLLXPXFKNXSVGXLYSGCRLTXLRXEKXGAATGXDAICXHXXXPKXPGL

XXXEXLYWELSXLTXXIXELGPYTLDRXSLYVNGFTHWSSGLTTSTPWTSTVDLGTSGTPSPVPSPTTAGP

LLVPFTLNFTITNLQYEEDMHRPGSRKFNATERVLQGLLSPIFKNTSVGPLYSGCRLTLLRPEKQEAATG

VDTICTHRVDPIGPGLXXEXLYWELSXLTXXIXELGPYTLDRXSLYVNGFTHXXSXPTTSTPGTSTVXXG

TSGTPSSXPXXTXXXPLLXPFTXNXTITNLXXXXXMXXPGSRKFNTTEXVLQGLLXPXFKNXSVGXLYSG

CRLTXLRXEKXGAATGXDAICXHXXXPKXPGLXXEXLYWELSXLTXXIXELGPYTLDRXSLYVNGFTHRS

FGLTTSTPWTSTVDLGTSGTPSPVPSPTTAGPLLVPFTLNFTITNLQYEEDMHRPGSRKFNTTERVLQGL

LTPLFRNTSVSSLYSGCRLTLLRPEKDGAATRVDAVCTHRPDPKSPGLXXEXLYWELSXLTXXIXELGPY

TLDRXSLYVNGFTHXXSXPTTSTPGTSTVXXGTSGTPSSXPXXTXXXPLLXPFTXNXTITNLXXXXXMXX

PGSRKFNTTEXVLQGLLXPXFKNXSVGXLYSGCRLTXLRXEKXGAATGXDAICXHXXXPKXPGLXXEXLY

WELSXLTXXIXELGPYTLDRXSLYVNGFTHWIPVPTSSTPGTSTVDLGSGTPSSLPSPTTAGPLLVPFTL

NFTITNLQYGEDMGHPGSRKFNTTERVLQGLLGPIFKNTSVGPLYSGCRLTSLRSEKDGAATGVDAICIH

HLDPKSPGLXXEXLYWELSXLTXXIXELGPYTLDRXSLYVNGFTHXXSXPTTSTPGTSTVXXGTSGTPSS

XPXXTXXXPLLXPFTXNXTITNLXXXXXMXXPGSRKFNTTEXVLQGLLXPXFKNXSVGXLYSGCRLTXLR

XEKXGAATGXDAICXHXXXPKXPGLXXEXLYWELSXLTXXIXELGPYTLDRXSLYVNGFTHQTFAPNTST

PGTSTVDLGTSGTPSSLPSPTSAGPLLVPFTLNFTITNLQYEEDMHHPGSRKFNTTERVLQGLLGPMFKN

TSVGLLYSGCRLTLLRPEKNGAATRVDAVCTHRPDPKSPGLXXEXLYWELSXLTXXIXELGPYTLDRXSL

YVNGFTHXXSXPTTSTPGTSTVXXGTSGTPSSXPXXTAPVPLLIPFTLNFTITNLHYEENMQHPGSRKFN

TTERVLQGLLKPLFKSTSVGPLYSGCRLTLLRPEKHGAATGVDAICTLRLDPTGPLDRERLYWELSQLT

NSVTELGPYTLDRDSLYVNGFTQRSSVPTTSIPGTSAVHLETSGTPASLPGHTAPGPLLVPFTLNFTITN

LQYEVDMRHPGSRKFNTTERVLQGLLKPLFKSTSVGPLYSGCRLTLLRPEKRGAATGVDTICTHRLDPLN

PGLDREQLYWELSKLTRGIIELGPYLLDRGSLYVNGFTHRNFVPITSTPGTSTVHLGTSETPSSLPRPIV

PGPLLVPFTLNFTITNLQYEEAMRHPGSRKFNTTERVLQGLLRPLFKNTSIGPLYSSCRLTLLRPEKDKA

ATRVDAICTHHPDPQSPGLNREQLYWELSQLTHGITELGPYTLDRDSLYVDGFTHWSPIPTTSTPGTSIV

NLGTSGIPPSLPETTXXXXPLLXPFTXNXTITNLXXXXXMXXPGSRKFNTTERVLQGLLKPLFKSTSVGPL

YSGCRLTLLRPEKDGVATRVDAICTHRPDPKIPGLDRQQLYWELSQLTHSITELGPYTLDRDSLYVNGFT

QRSSVPTTSTPGTFTVQPETSETPSSLPGPTATGPVLLPFTLNFTITNLQYEEDMHRPGSRKFNTTERVL

QGLLMPLFKNTSVSSLYSGCRLTLLRPEKDGAATRVDAVCTHRPDPKSPGLDRERLYWKLSQLTHGITEL

GPYTLDRHSLYVNGFTHQSSMTTTRTPDTSTMHLATSRTPASLSGPTTASPLLVLFTINFTITNLRYEEN

MHHPGSRKFNTTERVLQGLLRPVFKNTSVGPLYSGCRLTLLRPKKDGAATKVDAICTYRPDPKSPGLDRE

QLYWELSQLTHSITELGPYTLDRDSLYVNGFTQRSSVPTTSIPGTPTVDLGTSGTPVSKPGPSAASPLLV

LFTLNFTITNLRYEENMQHPGSRKFNTTERVLQGLLRSLFKSTSVGPLYSGCRLTLLRPEKDGTATGVDA

ICTHHPDPKSPRLDREQLYWELSQLTHNITELGHYALDNDSLFVNGFTHRSSVTTTSTPGTPTVYLGASK

TPASIFGPSAASHLLILFTLNFTITNLRYEENMWPGSRKFNTTERVLQGLLRPLFKNTSVGPLYSGSRLT

LLRPEKDGEATGVDAICTHRPDPTGPGLDREQLYLELSQLTHSITELGPYTLDRDSLYVNGFTHRSSVPT

TSTGVVSEEPFTLNFTINNLRYMADMGQPGSLKFNITDNVMKHLLSPLFQRSSLGARYTGCRVIALRSVK

NGAETRVDLLCTYLQPLSGPGLPIKQVFHELSQQTHGITRLGPYSLDKDSLYLNGYNEPGLDEPPTTPKP

ATTFLPPLSEATTAMGYHLKTLTLNFTISNLQYSPDMGKGSATFNSTEGVLQHLLRPLFQKSSMGPFYLG

CQLISLRPEKDGAATGVDTTCTYHPDPVGPGLDIQQLYWELSQLTHGVTQLGFYVLDRDSLFINGYAPQN

LSIRGEYQINFHIVNWNLSNPDPTSSEYITLLRDIQDKVTTLYKGSQLHDTFRFCLVTNLTMDSVLVTVK

ALFSSNLDPSLVEQVFLDKTLNASFHWLGSTYQLVDIHVTEMESSVYQPTSSSSTQHFYLNFTITNLPYS

QDKAPGTTNYQRNKRNIEDALNQLFRNSSIKSYFSDCQVSTFRSVPNRHHTGVDSLCNFSPLARRVDRV

AIYEEFLRMTRNGTQLQNFTLDRSSVLVDGYSPNRNEPLTGNSDLPFWAVILIGLAGLLGLITCLICGVL

VTTRRRKKEGEYNVQQQCPGYYQSHLDLEDLQ (hMUC17) SEQ ID NO: 45

MPRPGTMALCLLTLVLSLLPPQAAAEQDLSVNRAVWDGGGCISQGDVLNRQCQQLSQHVR

TGSAANTATGTTSTNVVEPRMYLSCSTNPEMTSIESSVTSDTPGVSSTRMTPTESRTTSE

STSDSTTLFPSSTEDTSSPTTPEGTDVPMSTPSEESISSTMAFVSTAPLPSFEAYTSLTY

KVDMSTPLTTSTQASSSPTTPESTTIPKSTNSEGSTPLTSMPASTMKVASSEAITLLTTP

VEISTPVTISAQASSSPTTAEGPSLSNSAPSGGSTPLTRMPLSVMLVVSSEASTLSTTPA

ATNIPVITSTEASSSPTTAEGTSIPTSTYTEGSTPLTSTPASTMPVATSEMSTLSITPVD

TSTLVTTSTEPSSLPTTAEATSMLTSTLSEGSTPLTNMPVSTILVASSEASTTSTIPVDS

KTFVTTASEASSSPTTAEDTSIATSTPSEGSTPLTSMPVSTTPVASSEASNLSTTPVDSK

TQVTTSTEASSSPPTAEVNSMPTSTPSEGSTPLTSMSVSTMPVASSEASTLSTTPVDTST

PVTTSSEASSSSTTPEGTSIPTSTPSEGSTPLTNMPVSTRLVVSSEASTTSTTPADSNTF

VTTSSEASSSSTTAEGTSMPTSTYSERGTTITSMSVSTTLVASSEASTLSTTPVDSNTPV

TTSTEATSSSTTAEGTSMPTSTYTEGSTPLTSMPVNTTLVASSEASTLSTTPVDTSTPVT

TSTEASSSPTTADGASMPTSTPSEGSTPLTSMPVSKTLLTSSEASTLSTTPLDTSTHITT

STEASCSPTTTEGTSMPISTPSEGSPLLTSIPVSITPVTSPEASTLSTTPVDSNSPVTTS

TEVSSSPTPAEGTSMPTSTYSEGRTPLTSMPVSTTLVATSAISTLSTTPVDTSTPVTNST

EARSSPTTSEGTSMPTSTPGEGSTPLTSMPDSTTPVVSSEARTLSATPVDTSTPVTTSTE

ATSSPTTAEGTSIPTSTPSEGTTPLTSTPVSHTLVANSEASTLSTTPVDSNTPLTTSTEA

SSPPPTAEGTSMPTSTPSEGSTPLTRMPVSTTMVASSETSTLSTTPADTSTPVTTYSQAS

SSSTTADGTSMPTSTYSEGSTPLTSVPVSTRLVVSSEASTLSTTPVDTSIPVTTSTEASS

SPTTAEGTSIPTSPPSEGTTPLASMPVSTTLVVSSEANTLSTTPVDSKTQVATSTEASSP

PPTAEVTSMPTSTPGERSTPLTSMPVRHTPVASSEASTLSTSPVDTSTPVTTSAETSSSP

TTAEGTSLPTSTTSEGSTLLTSIPVSTTLVTSPEASTLLTTPVDTKGPVVTSNEVSSSPT

PAEGTSMPTSTYSEGRTPLTSIPVNTTLVASSAISILSTTPVDNSTPVTTSTEACSSPTT

SEGTSMPNSNPSEGTTPLTSIPVSTTPVVSSEASTLSATPVDTSTPGTTSAEATSSPTTA

EGISIPTSTPSEGKTPLKSIPVSNTPVANSEASTLSTTPVDSNSPVVTSTAVSSSPTPAE

GTSIAISTPSEGSTALTSIPVSTTTVASSEINSLSTTPAVTSTPVTTYSQASSSPTTADG

TSMQTSTYSEGSTPLTSLPVSTMLVVSSEANTLSTTPIDSKTQVTASTEASSSTTAEGSS

MTISTPSEGSPLLTSIPVSTTPVASPEASTLSTTPVDSNSPVITSTEVSSSPTPAEGTSM

PTSTYTEGRTPLTSITVRTTPVASSAISTLSTTPVDNSTPVTTSTEARSSPTTSEGTSMP

NSTPSEGTTPLTSIPVSTTPVLSSEASTLSATPIDTSTPVTTSTEATSSPTTAEGTSIPT

STLSEGMTPLTSTPVSHTLVANSEASTLSTTPVDSNSPVVTSTAVSSSPTPAEGTSIATS

TPSEGSTALTSIPVSTTTVASSETNTLSTTPAVTSTPVTTYAQVSSSPTTADGSSMPTST

PREGRPPLTSIPVSTTTVASSEINTLSTTLADTRTPVTTYSQASSSPTTADGTSMPTPAY

SEGSTPLTSMPLSTTLVVSSEASTLSTTPVDTSTPATTSTEGSSSPTTAGGTSIQTSTPS

ERTTPLAGMPVSTTLVVSSEGNTLSTTPVDSKTQVTNSTEASSSATAEGSSMTISAPSEG

SPLLTSIPLSTTPVASPEASTLSTTPVDSNSPVITSTEVSSSPIPTEGTSMQTSTYSDRR

-continued

TPLTSMPVSTTVVASSAISTLSTTPVDTSTPVTNSTEARSSPTTSEGTSMPTSTPSEGST

PFTSMPVSTMPVVTSEASTLSATPVDTSTPVTTSTEATSSPTTAEGTSIPTSTLSEGTTP

LTSIPVSHTLVANSEVSTLSTTPVDSNTPFTTSTEASSPPPTAEGTSMPTSTSSEGNTPL

TRMPVSTTMVASFETSTLSTTPADTSTPVTTYSQAGSSPTTADDTSMPTSTYSEGSTPLT

SVPVSTMPVVSSEASTHSTTPVDTSTPVTTSTEASSSPTTAEGTSIPTSPPSEGTTPLAS

MPVSTTPVVSSEAGTLSTTPVDTSTPMTTSTEASSSPTTAEDIVVPISTASEGSTLLTSI

PVSTTPVASPEASTLSTTPVDSNSPVVTSTEISSSATSAEGTSMPTSTYSEGSTPLRSMP

VSTKPLASSEASTLSTTPVDTSIPVTTSTETSSSPTTAKDTSMPISTPSEVSTSLTSILV

STMPVASSEASTLSTTPVDTRTLVTTSTGTSSSPTTAEGSSMPTSTPGERSTPLTNILVS

TTLLANSEASTLSTTPVDTSTPVTTSAEASSSPTTAEGTSMRISTPSDGSTPLTSILVST

LPVASSEASTVSTTAVDTSIPVTTSTEASSSPTTAEVTSMPTSTPSETSTPLTSMPVNHT

PVASSEAGTLSTTPVDTSTPVTTSTKASSSPTTAEGIVVPISTASEGSTLLTSIPVSTTP

VASSEASTLSTTPVDTSIPVTTSTEGSSSPTTAEGTSMPISTPSEVSTPLTSILVSTVPV

AGSEASTLSTTPVDTRTPVTTSAEASSSPTTAEGTSMPISTPGERRTPLTSMSVSTMPVA

SSEASTLSRTPADTSTPVTTSTEASSSPTTAEGTGIPISTPSEGSTPLTSIPVSTTPVAI

PEASTLSTTPVDSNSPVVTSTEVSSSPTPAEGTSMPISTYSEGSTPLTGVPVSTTPVTSS

AISTLSTTPVDTSTPVTTSTEAHSSPTTSEGTSMPTSTPSEGSTPLTYMPVSTMLVVSSE

DSTLSATPVDTSTPVTTSTEATSSTTAEGTSIPTSTPSEGMTPLTSVPVSNTPVASSEAS

ILSTTPVDSNTPLTTSTEASSSPPTAEGTSMPTSTPSEGSTPLTSMPVSTTTVASSETST

LSTTPADTSTPVTTYSQASSSPPIADGTSMPTSTYSEGSTPLTNMSFSTTPVVSSEASTL

STTPVDTSTPVTTSTEASLSPTTAEGTSIPTSSPSEGTTPLASMPVSTTPVVSSEVNTLS

TTPVDSNTLVTTSTEASSSPTIAEGTSLPTSTTSEGSTPLSIMPLSTTPVASSEASTLST

TPVDTSTPVTTSSPTNSSPTTAEVTSMPTSTAGEGSTPLTNMPVSTTPVASSEASTLSTT

PVDSNTFVTSSSQASSSPATLQVTTMRMSTPSEGSSSLTTMLLSSTYVTSSEASTPSTPS

VDRSTPVTTSTQSNSTPTPPEVITLPMSTPSEVSTPLTIMPVSTTSVTISEAGTASTLPV

DTSTPVITSTQVSSSPVTPEGTTMPIWTPSEGSTPLTTMPVSTTRVTSSEGSTLSTPSVV

TSTPVTTSTEAISSSATLDSTTMSVSMPMEISTLGTTILVSTTPVTRFPESSTPSIPSVY

TSMSMTTASEGSSSPTTLEGTTTMPMSTTSERSTLLTTVLISPISVMSPSEASTLSTPPG

DTSTPLLTSTKAGSFSIPAEVTTIRISITSERSTPLTTLLVSTTLPTSFPGASIASTPPL

DTSTTFTPSTDTASTPTIPVATTISVSVITEGSTPGTTIFIPSTPVTSSTADVFPATTGA

VSTPVITSTELNTPSTSSSSTTTSFSTTKEFTTPAMTTAAPLTYVTMSTAPSTPRTTSRG

CTTSASTLSATSTPHTSTSVTTRPVTPSSESSRPSTITSHTIPPTFPPAHSSTPPTTSAS

STTVNPEAVTTMTTRTKPSTRTTSFPTVTTTAVPTNTTIKSNPTSTPTVPRTTTCFGDGC

QNTASRCKNGGTWDGLKCQCPNLYYGELCEEVVSSIDIGPPETISAQMELTVTVSVKFT

EELKNHSSQEFQEFKQTFTEQMNIVYSGIPEYVGVNITKLRLGSVVVEHDVLLRTKYTPE

YKTVLDNATEVVKEKITKVTTQQIMINDICSDMMCFNTTGTQVQNITVTQYDPEEDCRKM

AKEYGDYFVVEYRDQKPYCISPCEPGFSVSKNCNLGKCQMSLSGPQCLCVTTETHWYSGE

TCNQGTQKSLVYGLVGAGVVLMLIILVALLMLVFRSKREVKRQKYRLSQLYKWQEEDSGP

APGTFQNIGFDICQDDDSIHLESIYSNFQPSLRHIDPETKIRIQRPQVMTTSF (hMUC19)                                                              SEQ ID NO: 46

XXXXXXXXXXSGSTGVSAGSITASPGASATSSESSKSGSTEGSVEATTSAGSGNTAGTSG

TGDTGPGNTAGATGSSTGQTDTSGPSAKVTGNYGQSSEIPGTIKSSSDVSGTMGQSDTTS

GPSVAVTRTSEQSSGVTVASEPSVGVSGTTGPLAEISGTTRPLVSGLRTTGSSAEGSGTT

GPSSRESVTTRPLAEGSGTSGQSVTGSRATGLSATELGTTVSFTGGLGTSRSSARETRTT

GPSADGSGTTGPSVVRSGTTRLSVGVTRATESSPGVTGTTTPSAEESRTTGPSVLVTGTT

GQSGQGSGTTGKSFIESGPSVVGSGTTGPTSAGLGTTAPSTRRSSTTKPSVGRTGTTGQS

GAESGTTEPSARVAGVTGTSAEVSGRIEPSATESSTSRPLGETTGTTIPSMEGSEATGPS

VIGSETTRLSVIGSGTTGTSSGGSGATRSSGGGMGTTGQSTARSETTGPLFGLTGTFGQS

ATVTGTSSNSAGVTTPEKSPGVAMTTGLLVEGSATTQPRILESETTESSAGVIVTSGQSA

RVTGATGPSAGETGTTEPSTEGSVAAVLFVIGSETTRPLDIGSGTTGTLSGGSSTTRSSD

GTTGTTRKSTARSETTGLSGLTGTSGQLAGVTGTSSKSAGVTVTSEKSAGVAVITGSFVE

RPVTTGPPLLESETTRPSGGVTVTSGQSARVTETVGASAGVTGTTGPSTEGSGATGPSVV

GSGTTRPLAGESGTTESSAGVTGTRPSSSRESATTGPSDEGSGTTGLSAGVTVTSGQSVR

KTGTTGAPAGVTETTRPSVVKSGTTGPSVIGTRTTGTSSGGSGATRSSGGETETTGQSAV

KSGTTESFTRLTRTSGQSAGMTGTSAQSAGVALTSPFVEGLVTTGSSTVGLETTRPSAVG

SGKTGPPVVKAQTTGPSAGVTVTSGQSARMTGASGPSVGVTGTTGPASKGLGTIRPSVVG

LETTELSAEGSGTTGPPIVGETTVPSAGVTVTSGYSDRVTGATEPLAGVTGTIKPSVAGS

VTTGPSVTGVETTAKTTSGGLSTTISSVGGTGTTGQSPERSGTTGPFTGLTGTSAQSAGV

TMTSIQSAGVLVTTGLNVDGLGTTGKALIGSGTTGLSAEATGTIGPSTEGLEKTGPSITG

SGTTRPLVTESWTAGTSSGGHSTTSPSVRGTETTGQSAAESVTTGPVTGYTETSGPSAGV

TVTPRQSPTVTQTTGSSAAVSGTTVQSLTVSGTTRPSSGQTEITGSSVKESGTTESSAVR

SGTTGPTAGVTGTNGPSSAGVTGITGSSPGVTGTTGSSPGVTGTTGSSARSGTSIPSVGK

TGTTRTSVEESRTTRPSAGITGTNGLSAEVTGTTGPLAGVTGTTGPSAGVTRTTGLSAGE

TGTTGLSPGVTRTTRSSAGLTGKTGLSAGVTGKTGLSAEVTGTTRLSAGVTGTTGPSPGV

TGTTGTPAGVTGTTELSAGVTGKTGLSSEVTETTGLSYGVKRTIGLSAGSTGTSGQSAGV

AGTTTLSAEVTGTTRPSAGVTGTTGLSAEVTEITGISAVVTGTTGPSAGVTETTGSSAGV

AGTTRLSAGVTGITGLSAGVTGTTGLSTEVTGTTGPSAGATGTTGLSVGVTGITGLSDVV

TETTGSSARSGTGIPSVGETRTTSTSVEESRTTRPSAGIMGTNGLPAEVTGTTEPLAGGT

GTTGILAGVTGTTGLSAGETGKIGSSAGVTGKTGSSARVTGKTGPSAEVTGKTGLSAGVT

GTTGLSPGVTGTSGLSAEVTGTTGPSAEATGLPGVSAGVTGTTGSLAGGTGTIGLSAGVT

GTTGSSAGVTGTTGLSAGVTGIAGLSAGVTGITGPSAGVTGTTTVSAGVTGTTGLSAEAT

EITGLSAGVTGTTGLSAGVTETIRLSAGVTGTIRSSAGVTGITGLSAGVTGTTGPSAGVT

GSTGLLAGVTETTGQSAKVTGTTGQSVGVTGTTRSSGGVTGITGLSAGVTGTNGLSAVTG

MTGLSAEVTGTTGLSVGVTGIAGLSAGVTGITGPSAGITGTTTISAGVTGTSGLSAEATG

ITGLSAGVTGKTGLSAGVTETIGLSAEATGTIGSSPGVTGTTGSSTGVTGITGLSAGVTG

TTGLSTEVTGTTGPSAGVTRTTGLSAGVTGITGLSAIVTETTGSSARSGTSIPSVGETGT

TRTSVEESRTTRPSAGITGTTGLSAGVTGTVGSSAVVTGTTGLSAGVTGTTGPSAEETGA

```
TGPSAEVTETTGPSAGVTGTGRLSAEVTGTTGPSAEVTGLPGESAEVTGTIGSPAGVTGT
TQLSAVVTGITGLSAEVTGTTGLSAGVTGITGLSAEVTRTTGLSAGVTGTIGLSAGVTGT
TRPSAGVTGTTGQSAEVTGTTEPSAGLTETTGSSTGVTGATGPLAGVTGTTGISTEVTGT
TGPSARVTGTTVLSAGVTGITGLSAIVTETTGSSARSGTSTPSVGETGTTRTSVEESRAT
RPSAGITGTNGQSAEVTWITGPLAGVTGTTGISAGVTGTTGLSAGVTGTIGSSAVVTGIN
GLSAGVTGTTGPSAEETGATGPSAEVTGTTGPSAEETGATGPSAEVTGTTGPSGGVTGTN
GLSAEVTGTTGPSAEVTGLPGVSAGVTGTIGSPAAVTGTIRPSAVVTGITGLSAEVTGTT
GLSAWVTGIAGLSAGVTETIGSSAGVTGTNGLSAEATGTTGPSAGVTGTTGLSAGVTGTA
GLSARVTESTGLSAGVTGTTGLSAGVTGTTGPSAGITGTNGLSAEVTGTTGPLAGVTGTI
GLSAGVTGIAGLSAGVTESTGLSAGVTGTIRSSAVVTGINGLSAGVTGTTGPSAEETGAT
GPSAEVTGTTGPSGGVTGTSGISAEVTGTTGPSAEVTGLPGVSAGVTGTIGSPAAVTGTT
RPSAVVTGISGLSAEVTGTTGLSAGVTETIGSSAGVTGTNGLSAEATETTGPSAGVTGTT
GLSAGVTGTTGPSAGIAGTNGLSAGVTGTTGLSARVTESTGLSAGVTGTIGSSAVVTETT
RLSSGVTGTIGPSAEETGATGLSAEVTGTTGSLAEVTGTTGLSAGVTGTIGSSAVVTGTT
GLSAGITGTNGLSAEVTGTAGPLAGVTGTTGLSAGVTGTTGLSAGVTETTGQSAGVTEST
GLSPGVTGTIGSSAVVTGIKGLSAGVTGTTGPSAEETGATGPSAEVTGTTGPSGGVTGTS
VLSVEVTGTTGPSAEVTGLPGVSAGLTGTIGSPAAVRGTTWPSAVVTGISGLSGEVTGTT
GLSAGVTGIGGLSAGVTGTIGSSAGVTGTNALSAEATGTTGPSAGVTGTTGLSAGVTGTT
GLSAGVTGTIRSSAVVTETTGLSAGVTGTTGPSAGIAGTNGLSAEVTGTTGLSAGMTGTT
GLSARVTESTGLSAGVTGTIGSSAVVTETTRLSAGVTGTIGPSAEETGATGLSAEVTRTT
GSLAGVTGTTGPSAVVTGKTELSAEVTGTTELSAEVTEKTGPSAEVTGKTGLSAGVMETT
GPSAEVTGTTGSSAGVTGTTGPSAGVTGTTGPSAEATGLPGVSAGVTGTIGSPAGVTGTA
RLSAVVTGISGLSAEVTGTTGLSTGVTGIAGHSAAVTGITRPSAGVTGTTTVSAGVTGTI
GLSAEATGITLPSAGVTETTGLSAGVTETIGLSAGVTGTIGSSAGVTEITGLSAGVTGTT
GPSAGVTGSTVLSAGVTATTGQSVGVTGTTGPSAGVTGTTGLSAGVTGIAGLSAGVTGIT
GPSAGVTGTTTVSAGVTGTTGLSAEATEITGLSAGVTGTTGLSAGVTGIAGLSAGVTETI
GSSAGVTGTNGLSAEATGKTGPSAGVTGTTGLSAGVTGTTGLSAGVTETIGLSAGVTGTI
GSSAGVKGTTGQSAEVTGATGQSVGVTGTTRSSGGVTGITGLSAGLRGTTVSSAKAGTSI
PLTGKTGTTRTSVEESTTTGPSAGITGTNGLSAEMTGTNELSAGVTGTIGSSAGVTGTTG
LSVEATVTTGLSAGVTGTTVPLAGVTWTPGPSAGVTGIAALSAGVTGKSGLSAGVTGKTG
LSAGVTGTTGPSAEATGKTGLSAGVTGITGPFAEVTGTTGLSAGVIGTTGSSAEVTGITG
LSAGVTGKTRSSAGVTGTTGLSAKSGTSIPSAGKTGTTKTSVEESRTTRPSAGITGTNGL
PARVTGTXXXXXXXXXXGTSGVAPGTTVAPGSFSTAATTSPGASGVTGTGPTAETTTFLG
GSSTTGAEIKSGATTGAPGSKTGTAKVLSGTTVASGSSNSEATTFSGITEAVTVPSKNGS
MTTALGSQLSSSQTVIPGSSGTISHTTVAPGSSVTGTTTGASDDQVTGSKTGTTGVALST
TVAPGSSSTEATTSTGVHRTTVVGQKTGATTRGSAKQGTRSTIEATTSFRGTGTTGSGMN
TGTTGVVSGNTISPSSFNTEATSGTSERPNPGSEIGTTGIVSGTTVAPGSSNTEATTSLG
NGGTTEAGSKIVTTGITTGTTIVPGSFNTKATTSTDVGVATGVGMATGITNIISGRSQPT
GSKTGYTVTGSGTTALPGGFRTGNTPGSTGVTSSQEGTTVVSSGITGIPETSISGPSKEA
SDKTTAPGPPTTVTASTGVKETSETGVQTGSTLVTAGVPTRPQVSQPETTVVATREVETE
NKTECLASLPPAPVCHGPLGEEKSPGDIWTANCHRGTCTDAKTIDCKPEECPSPPTCKTG
```

EKLVKFQSNDTCCEIGYCEPRTCLFNNTDYEIGASFDDPSNPCVSYSCKDTGFAAVVQDC

PKQTWCAEANRIYDSKKCCYTCKNNCRSSLVNVTVIYSGCKKRVQMAKCTGECEKTAKYN

HDILLLEHSCLCCREENYELRDIVLDCPDGSTIPYQYKHITTCSCLDICQLYTTFMYS (hMUC20) SEQ ID NO: 47

MGCLWGLALPLFFFCWEVGVSGSSAGPSTRRADTAMTTDDTEVPAMTLAPGHAALETQTL

SAETSSRASTPAGPIPEAETRGAKRISPARETRSFTKTSPNFMVLIATSVETSAASGSPE

GAGMTTVQTITGSDPREAIFDTLCTDDSSEEAKTLTMDILTLAHTSTEAKGLSSESSASS

DSPHPVITPSRASESSASSDGPHPVITPSRASESSASSDGPHPVITPSRASESSASSDGP

HPVITPSRASESSASSDGPHPVITPSRASESSASSDGPHPVITPSRASESSASSDGPHPV

ITPSRASESSASSDGPHPVITPSRASESSASSDGPHPVITPSRASESSASSDGLHPVITP

SRASESSASSDGPHPVITPSRASESSASSDGPHPVITPSWSPGSDVTLLAEALVTVTNIE

VINCSITEIETTTSSIPGASDTDLIPTEGVKASSTSDPPALPDSTEAKPHITEVTASAET

LSTAGTTESAAPDATVGTPLPTNSATEREVTAPGATTLSGALVTVSRNPLEETSALSVET

PSYVKVSGAAPVSIEAGSAVGKTTSFAGSSASSYSPSEAALKNFTPSETPTMDIATKGPF

PTSRDPLPSVPPTTTNSSRGTNSTLAKITTSAKTTMKPPTATPTTARTRPTTDVSAGENG

GFLLLRLSVASPEDLTDPRVAERLMQQLHRELHAHAPHFQVSLLRVRRG (MUC 21) SEQ ID NO: 48

MKMQKGNVLLMFGLLLHLEAATNSNETSTSANTGSSVISSGASTATNSGSSVTSSGVSTATISGSSVTSN

GVSIVTNSEFHTTSSGISTATNSEFSTASSGISIATNSESSTTSSGASTATNSESSTPSSGASTATNSDS

STTSSGASTATNSDSSTTSSEASTATNSESSTTSSGASTATNSESSTVSSRASTATNSESSTTSSGASTA

TNSESRTTSNGAGTATNSESSTTSSGASTATNSESSTPSSGAGTATNSESSTTSSGAGTATNSESSTVSS

GISTVTNSESSTPSSGANTATNSESSTTSSGANTATNSDSSTTSSGASTATNSESSTTSSGASTATNSES

STTSSGASTATNSGSSTTSSGTSTATNSESSTVSSGASTATTSESSTTSSGASTATNSESSTVSSGASTA

TNSESSTTSSGANTATNSGSSVTSAGSGTAALTGMHTTSHSASTAVSEAKPGGSLVPWEIFLITLVSVVA

AVGLFAGLFFCVRNSLSLRNTFNTAVYHPHGLNHGLGPGPGGNHGAPHRPRWSPNWFWRRPVSSIAME

MSGRNSGP (MUC HEG) SEQ ID NO: 49

MASPRASRWPPPLLLLLLPLLLLPPAAPGTRDPPPSPARRALSLAPLAGAGLELQLERRP

EREPPPTPPRERRGPATPGPSYRAPEPGAATQRGPSGRAPRGGSAASESLHLPSSSSEFD

ERIAAFQTKSGTASEMGTERAMGLSEEWTVHSQEATTSAWSPSFLPALEMGELTTPSRKR

NSSGPDLSWLHFYRTAASSPLLDLSSSSESTEKLNNSTGLQSSSVSQTKTMHVATVFTDG

GPRTLRSLTVSLGPVSKTEGFPKDSRIATTSSSVLLSPSAVESRRNSRVTGNPGDEEFIE

PSTENEFGLTSLRWQNDSPTFGEHQLASSSEVQNGSPMSQTETVSRSVAPMRGGEITAHW

LLTNSTTSADVTGSSASYPEGVNASVLTQFSDSTVHSANAEDRTSGVPSLGTHTLATVTG

NGERTLRSVTLTNTSMSTTSGEAGSPAAAMHQETEGASLHVNVTDDMGLVSRSLAASSAL

GVAGISYGQVRGTAIEQRTSSDHTDHTYLSSTFTKGERALLSITDNSSSSDIVESSTSYI

KISNSSHSEYSSFFHAQTERSNISSYDGEYAQPSTESPVLHTSNLPSYTPTINMPNTSVV

LDTDAEFVSDSSSSSSSSSSSSSSGPPLPLPSVSQSHHLFSSILPSTRASVHLLKSTSDA

STPWSSSPSPLPVSLTTSTSAPLSVSQTTLPQSSSTPVLPRARETPVTSFQTSTMTSFMT

MLHSSQTADLKSQSTPHQEKVITESKSPSLVSLPTESTKAVTTNSPLPPSLTESSTEQTL

-continued

PATSTNLAQMSPTFTTTILKTSQPLMTTPGTLSSTASLVTGPIAVQTTAGKQLSLTHPEI

LVPQISTEGGISTERNRVIVDATTGLIPLTSVPTSAKEMTTKLGVTAEYSPASRSLGTSP

SPQTTVVSTAEDLAPKSATFAVQSSTQSPTTVSSSASVNSCAVNPCLHNGECVADNTSRG

YHCRCPPSWQGDDCSVDVNECLSNPCPSTAMCNNTQGSFICKCPVGYQLEKGICNLVRTF

VTEFKLKRTFLNTTVEKHSDLQEVENEITKTLNMCFSALPSYIRSTVHASRESNAVVISL

QTTFSLASNVTLFDLADRMQKCVNSCKSSAEVCQLLGSQRRIFRAGSLCKRKSPECDKDT

SICTDLDGVALCQCKSGYFQFNKMDHSCRACEDGYRLENETCMSCPFGLGGLNCGNPYQL

ITVVIAAAGGGLLLILGIALIVTCCRKNKNDISKLIFKSGDFQMSPYAEYPKNPRSQEWG

REAIEMHENGSTKNLLQMTDVYYSPTSVRNPELERNGLYPAYTGLPGSRHSCIFPGQYNP

SFISDESRRRDYF (MUC9)
SEQ ID NO: 50
MWKLLLWVGL VLVLKHHDGA AHKLVCYFTN WAHSRPGPAS ILPHDLDPFL CTHLIFAFAS

MNNNQIVAKD LQDEKILYPE FNKLKERNRE LKTLLSIGGW NFGTSRFTTM LSTFANREKF

IASVISLLRT HDFDGLDLFF LYPGLRGSPM HDRWTFLFLI EELLFAFRKE ALLTMRPRLL

LSAAVSGVPH IVQTSYDVRF LGRLLDFINV LSYDLHGSWE RFTGHNSPLF SLPEDPKSSA

YAMNYWRKLG APSEKLIMGI PTYGRTFRLL KASKNGLQAR AIGPASPGKY TKQEGFLAYF

EICSFVWGAK KHWIDYQYVP YANKGKEWVG YDNAISFSYK AWFIRREHFG GAMVWTLDMD

DVRGTFCGTG PFPLVYVLND ILVRAEFSST SLPQFWLSSA VNSSSTDPER LAVTTAWTTD

SKILPPGGEA GVTEIHGKCE NMTITPRGTT VTPTKETVSL GKHTVALGEK TEITGAMTMT

SVGHQSMTPG EKALTPVGHQ SVTTGQKTLT SVGYQSVTPG EKTLTPVGHQ SVTPVSHQSV

SPGGTTMTPV HFQTETLRQN TVAPRRKAVA REKVTVPSRN ISVTPEGQTM PLRGENLTSE

VGTHPRMGNL GLQMEAENRM MLSSSPVIQL PEQTPLAFDN RFVPIYGNHS SVNSVTPQTS

PLSLKKEIPE NSAVDEEA (MUC18)
SEQ ID NO: 51
MGLPRLVCAF LLAACCCCPR VAGVPGEAEQ PAPELVEVEV GSTALLKCGL SQSQGNLSHV

DWFSVHKEKR TLIFRVRQGQ GQSEPGEYEQ RLSLQDRGAT LALTQVTPQD ERIFLCQGKR

PRSQEYRIQL RVYKAPEEPN IQVNPLGIPV NSKEPEEVAT CVGRNGYPIP QVIWYKNGRP

LKEEKNRVHI QSSQTVESSG LYTLQSILKA QLVKEDKDAQ FYCELNYRLP SGNHMKESRE

VTVPVFYPTE KVWLEVEPVG MLKEGDRVEI RCLADGNPPP HFSISKQNPS TREAEEETTN

DNGVLVLEPA RKEHSGRYEC QGLDLDTMIS LLSEPQELLV NYVSDVRVSP AAPERQEGSS

LTLTCEAESS QDLEFQWLRE ETGQVLERGP VLQHDLKRE AGGGYRCVAS VPSIPGLNRT

QLVNVAIFGP PWMAFKERKV WVKENMVLNL SCEASGHPRP TISWNVNGTA SEQDQDPQRV

LSTLNVLVTP ELLETGVECT ASNDLGKNTS ILFLELVNLT TLTPDSNTTT GLSTSTASPH

TRANSTSTER KLPEPESRGV VIVAVIVCIL VLAVLGAVLY FLYKKGKLPC RRSGKQEITL

PPSRKSELVV EVKSDKLPEE MGLLQGSSGD KRAPGDQGEK YIDLRH (p53 peptide)
SEQ ID NO: 52
QETFSDLWKLLPENN (p53 peptide)
SEQ ID NO: 53
DLWKLLPENNVLSPL (p53 peptide)
SEQ ID NO: 54
DDLMLSPDDIEQWFT -continued (p53 peptide)

SPDDIEQWFTEDPGP                                    SEQ ID NO: 55

(p53 peptide)

MPEAAPRVAPAPAAP                                    SEQ ID NO: 56

(p53 peptide)

SVTCTYSPALNKMFC                                    SEQ ID NO: 57

(p53 peptide)

YSPALNKMFCQLAKT                                    SEQ ID NO: 58

(p53 peptide)

NKMFCQLAKTCPVQL                                    SEQ ID NO: 59

(p53 peptide)

SQHMTEVVRRCPHHE                                    SEQ ID NO: 60

(p53 peptide)

PQHLIRVEGNLRVEY                                    SEQ ID NO: 61

(p53 peptide)

LRVEYLDDRNTFRHS                                    SEQ ID NO: 62

(p53 peptide)

LDDRNTFRHSVVVPY                                    SEQ ID NO: 63

(p53 peptide)

TFRHSVVVPYEPPEV                                    SEQ ID NO: 64

(p53 peptide)

VVVPYEPPEVGSDCT                                    SEQ ID NO: 65

(p53 peptide)

EPPEVGSDCTTIHYN                                    SEQ ID NO: 66

(p53 peptide)

KKGEPHHELPPGSTK                                    SEQ ID NO: 67

(p53 peptide)

HHELPPGSTKRALPN                                    SEQ ID NO: 68

(p53 peptide)

KKLMFKTEGPDSD                                      SEQ ID NO: 69

Example 2

Materials and Methods

Synthesis of O-Glycopeptides: Chemoenzymatic Synthesis of Library

Synthetic peptides: A MUC1 60-mer peptide (VTSAP-DTRPAPGSTAPPAHG)$_{n=3}$ representing three tandem repeats were kindly provided by Cancer Research UK. A 24-mer peptide derived from the C-terminal degenerate tandem repeats of MUC1 (AHGVTSAPDNRPALGSTAP-PVHNV) was synthesized by Schafer-N. A MUC2 33-mer peptide (PTTTPITTTTTVTPTPTPTGTQTPTTTPISTTC) corresponding to 1.4 tandem repeat was synthesized as previously described (Sabbatini, Ragupathi et al. 2007).

Eight chemically synthesized 21-mer MUC1 tandem repeat glycopeptides with single Tn or T glycans were available. MUC4 peptides included: (PMTDTKTVTTPGSSFTA), (PGSSFTASGHSPSEIVPQD), (SEIVPQDAPTISAAT-TFAPA), (TTFAPAPTGNGHTTQAPTTA), (TTQAPT-TALQAAPSSHD), (APSSHDATLGPSGGTSLSKT), (SLSKTGALTLANSVVSTP), (NSVVSTPGGPEGQWT-SASAS), (TSASASTSPRTAAAMTHT), (AAAMTH-THQAESTEASGQT), (EASGQTQTSEPASSGSRTT), (PASSGSRTTSAGTATPSSS), (TATPSSSGAS-GTTPSGSEGI), (SGSEGISTSGETTRFSSN), (GETTRF-SSNPSRDSHTT), (PVTSPSSASTGHTTPLPVTDTSSAS-TGDTTP), (LPVTSLSSVSTGDTTPLPVTSPSSASTGH), (LPVTSPSSASTGHASPLLVTDASSASTGQ), (PLPVTSPSSASTGHASPLLVTDASSASTGQ), (STGDTLPLPVTDTSSV), (PVTYASSASTGDTTPLPVT-DTSSVSTGHAT).

Peptides were synthesized at Peptides and Elephants, Gmbh, Germany or Schaefer-N, Copenhagen, Denmark.

Figure 1B:
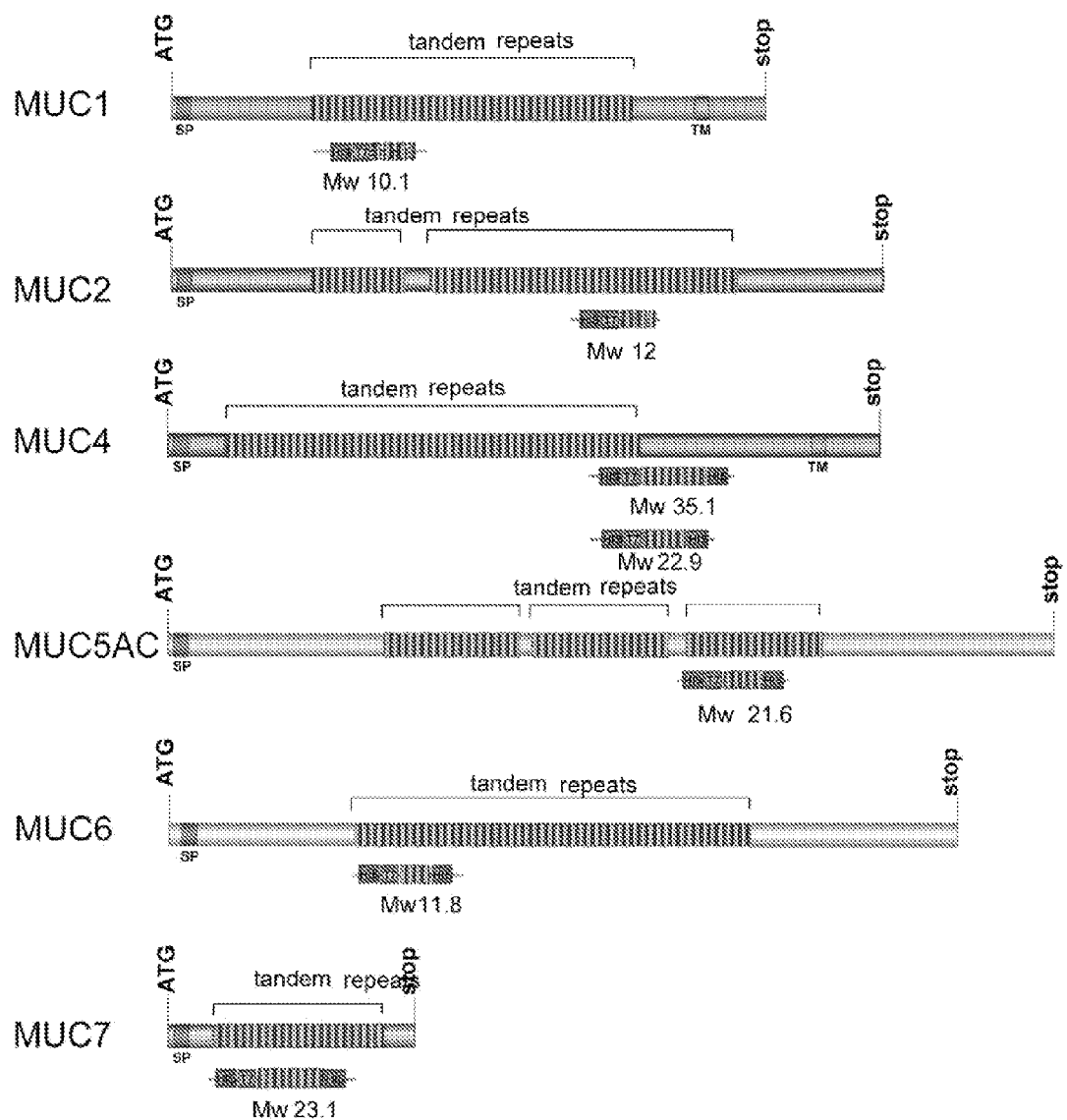
FIG. 1: The O-glycopeptide microarray platform. (A) Biosynthetic pathways of the initial steps in the most common mucin-type O-glycans. Each pathway can be further elongated and modified (not shown). Candidate glycosyltransferases responsible for each biosynthetic step are indicated. (B) Graphical overview of a number of studied mucins explored in the present work. Demonstrated are signal sequences (SP), tandem repeat domains (TR), and transmembrane domains (TM). MUC1 and MUC4 are membrane associated mucins, while MUC2, MUC5AC, MUC6, and MUC7 are secreted mucins. (C) Position of the glycopeptides on the array. Peptides were printed in three different concentration and four replicates. (D) Fluorescent image of glycopeptide array with bound monoclonal antibodies specific for the peptide tandem repeat of MUC1 (5E10) and carbohydrate structures Tn (GalNAcα) and STn (NeuAcα6GalNAcα). Monoclonal antibodies were detected with Cy3-conjugated anti-mouse IgG overlaid onto the printed glycopeptide array, washed, and scanned for fluorescence. (E) Quantification of antibody recognition profiles is shown next to each fluorescent image with the use of the mean value of the 4 replicates.
Figure 1C:
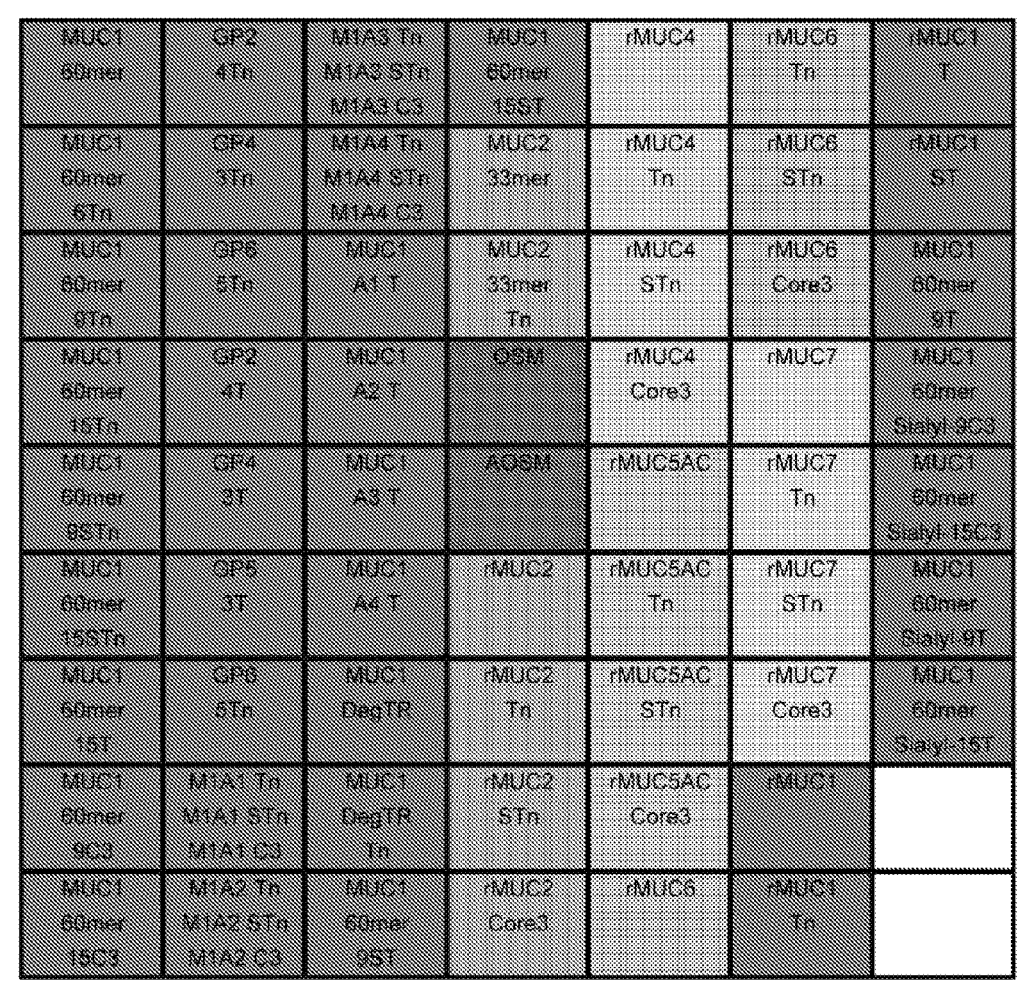

Synthesis of recombinant mucin glycoprotein fragments in *E. coli*: N- or C-terminally 6×His and T7 tagged recombinant fragments of MUC2, MUC4, MUC5AC, MUC6, and MUC7 were produced in *E. coli* (See FIG. 1B). Gene sequences were inserted into the bacterial expression vectors pET22 (Novagen), pET28 (Novagen) or pET28 (minus), a modified pET 28 vector without N-terminal tags. More than 10 bacterial strains were tested for expression fidelity and efficacy of recombinant mucin protein fragments. Robustness of the system was tested using different expression strategies for mucin-like gene sequences. Expression yields varied from 6 mg/l to 50 mg/l. Based on this, Rosetta2 (Novagen) was selected as the expression host. Overnight cultures were diluted 1:100, and induced 4 h at 37° C. by the addition of IPTG to a final concentration of 0.1 mM. Cell lysates were nickel purified using NiNTA agarose (Qiagen) as described by the manufacturer, and the eluted fractions were analyzed by SDS-PAGE on NuPAGE Bis-Tris 8-12% acryl amide gels (Novex) stained with Coomassie. Eluted fractions of recombinant mucin fragments were HPLC purified before and after in vitro O-glycosylation (see below). Samples were diluted in 0.1% TFA (trifluoroacetic acid), loaded onto a Zorbax 300SB-C18 column mounted on an Agilent 1100 HPLC system, and eluted in a 40-minute linear gradient from 0-90% acetonitrile. Eluted fractions were lyophilized and resuspended in water and mass confirmed by MALDI-TOF mass spectrometry. MALDI-TOF mass spectrometry was performed on a Voyager-DE™ PRO workstation (Applied Biosystems) using 2,5-dihydroxybenzoic acid (Sigma) as matrix (Mirgorodskaya, Hassan et al. 1999).

Synthesis of O-Glycopeptides:

Peptides and recombinant fragments were O-glycosylated in vitro using recombinant glycosyltransferases as previously described (Tarp, Sorensen et al. 2007) (Wandall, Irazoqui et al. 2007) Briefly, different polypeptide GalNAc-transferase isoforms were used to direct GalNAc O-glycan occupancies on peptides and the *Drosophila* Core-1 β3GalT, human Core-3 β3GlcNAc-T and human ST6GalNAc-I were used to produce T, Core-3 and STn glycoforms. See FIG. 1A for structures of glycopeptides. All glycopeptides were HPLC purified and characterized by MALDI-TOF.

Mucin O-Glycopeptide Array Print and Analysis:

(Glyco)peptides and control structures were printed on Schott Nexterion® Slide H or Schott Nexterion® Slide H MPX 16 (Schott A G, Mainz, Germany). Quadruplicates of all compounds were printed at 20, 5, and 1 µM in 150 mM sodium phosphate pH 8.5 with 0.005% CHAPS and printed on a BioRobotics MicroGrid II spotter (Genomics Solution) with a 0.21 mm pitch using Stealth 3B Micro Spotting Pins (Telechem International Arraylt Division). After printing, slides were incubated for 1 h in a humidified hybridization chamber with 75% relative humidity and stored until use at −20° C. Prior to use the microarrays were blocked for 1 h with 25 mM ethanolamine in 100 mM sodium borate pH 8.5. Human sera serially diluted from 1:25-1:400 or monoclonal antibodies (1 µg/ml or hybridoma supernatants) were incubated in a closed container with gentle agitation for 1 h, washed three times in PBS with 0.05% Tween-20 (PBS-T), followed by 1 h incubation with appropriate secondary antibodies. Human IgM and IgG antibodies were detected with Cy3-conjugated goat anti-human IgG (Fc specific) and goat anti-human IgM (Sigma) diluted 1:5000 in PBS-T. For subclass characterization, biotinylated mouse anti-human IgM, IgG$_1$, IgG$_2$, IgG$_3$ and IgG$_4$ (Sigma) were used and subsequently labelled with Streptavidin-DyLight547 (Pierce), both diluted 1:5,000 in PBS-T. Murine monoclonal antibodies were detected with Cy3-conjugated goat anti-mouse IgM (µchain specific) and goat anti-mouse IgG (H+L) (Jackson ImmunoResearch Laboratories, Inc.) diluted 1:5000 in PBS-T. After incubation with secondary antibodies the slides were washed 3 times in PBS-T, and after the final wash, slides were rinsed shortly in H$_2$O, dried by centrifugation (200×g) and scanned in a ProScanArray HT Microarray Scanner (PerkinElmer) followed by image analysis with ProScanArray Express 4.0 software (PerkinElmer). Each spot were done in 4 replicates and the mean value of relative fluorescence intensity (RFU) was used. A positive sample from the colorectal cancer group was included on each experiment to confirm the reproducible of the assay allowing inter-experimental comparison. For comparison, slides were scanned with identical scanning parameters. Data were analyzed and plotted using Microsoft Excel or Graph Pad Prism software.

Monoclonal Antibodies:

Printing of the MUC1 glycopeptides was confirmed using monoclonal antibodies against MUC1 (HMFG2)(5E10), T-MUC1 (1B9) and 5E5 (Tn-MUC1). Additional mucin fragments were detected with anti-His (AD.1.10; Santa Cruz Biotechnology, USA; Sc-53073) and anti-T7 antibodies (Novagen, USA; 69522) as well as carbohydrate-specific antibodies targeting Tn (1E3) and STn (3F1).

Human Sera:

Human colorectal cancer sera were obtained from Asterand, Inc., USA and from Hillerod Hospital. Sera from IBD patients were collected from Herlev University Hospital, control sera were obtained from healthy blood donors.

Quantification of Serum MUC1:

MUC1 capture ELISA was performed as previously described (Wandall 2009). Briefly, Immuno MaxiSorp F96 plates (Nunc) were coated with 1 µg/mL mAb HMFG2, blocked, and incubation with serially diluted sera. Amount of bound MUC1 was detected using biotinylated MUC1 specific antibody HMFG2.

Generation of Monoclonal Antibodies:

Female Balb/c mice were immunized with 15Core-3-MUC1 60-mer glycopeptide, Tn-MUC4 20mer peptide PVTYASSASTGDTTPLPVTDTSSVSTGHAT and recombinant Tn-MUC4 all conjugated to KLH. Eye bleeds were collected 7 days after the third immunisation and sera tested by ELISA, with the Core-3/Tn-MUC2 glycopeptide serving as negative control or by immunocytochemistry. Three days after the fourth immunisation, spleen cells from one mouse were fused with NS1 myeloma cells (Kohler and Milstein 1975). Hybridomas specific to the antigens of interest were cloned by limiting dilution at least three times.

Immunocytochemistry and Immunohistochemistry:

6-10 µm tissue sections were fixed for 5 min in ice-cold acetone or 4% paraformaldehyde. Fixed cells were incubated 2 hours at room temperature or overnight at 4° C. with undiluted mAb supernatants, followed by incubation for 45 min at room temperature with fluorescein isothiocyanate-conjugated rabbit anti-mouse immunoglobulins in 1:100 dilution with 0.1% BSA (Dako). Slides were mounted in glycerol-containing p-phenylenediamine and examined in a Zeiss fluorescence microscope.

Cellular Immune Response:

Peripheral blood mononuclear cells (PBMCs) were isolated from heparin anti-coagulated blood of patients with late stage (III-IV) colorectal cancer using Lymphoprep (Nycomed Pharma AS, Oslo, Norway). Cells were then cultured in X-VIVO 15 medium (Invitrogen) together with 2% heat inactivated human AB serum (Valley Biomedical, Winchester, USA) in round bottom microculture plates (Nunc, Roskilde, Denmark). Cells were cultured as $2*10^5$ cells/well and stimulated with peptide pools with 10 peptides in each pool (all from Schafer-N, Copenhagen, Denmark). The concentration of each peptide was 10 mg/ml and the peptide pools were 15-mer peptides with 10 amino acid overlapping, which allowed to test for reactivity against peptides representing the whole MUC1 peptide backbone. 50 IU/ml IL-2 (Proleukin, Chiron, The Netherlands) was added at day 1 and cells were harvested at day 9 and restimulated with the same peptide pools or without peptide as a negative control in an IFN-g ELISPOT assay (Svane, Pedersen et al. 2004) in order to identify MUC-1 specific CD4+ or CD8+ T cells.

Results

Assembly of the Mucin O-Glycopeptide Array

The employed strategy was based on chemo-enzymatic synthesis of large glycopeptides, either based on synthetic peptides or large mucin fragments produced in e-coli, and use micro-array technology to identify the most promising targets, followed by their deconvolution by overlapping glycopeptides.

Figure 1D:
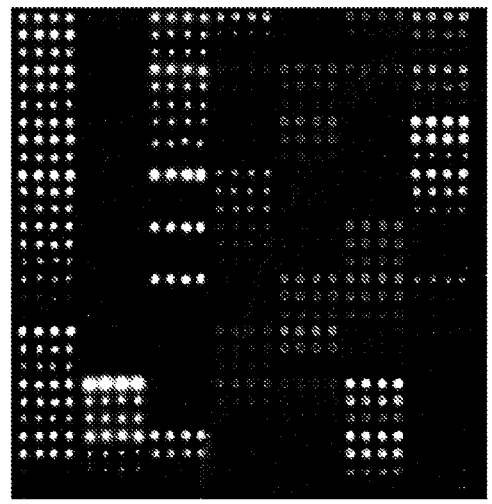
Figure 1D:
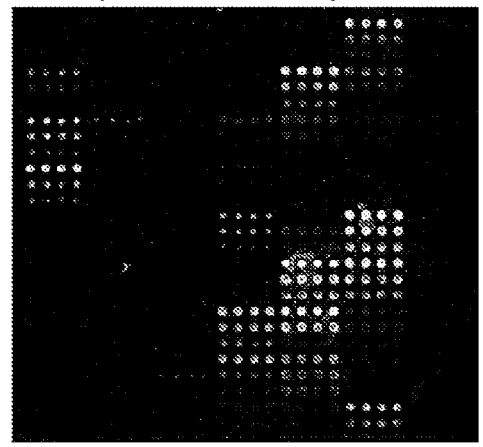
Figure 1D:
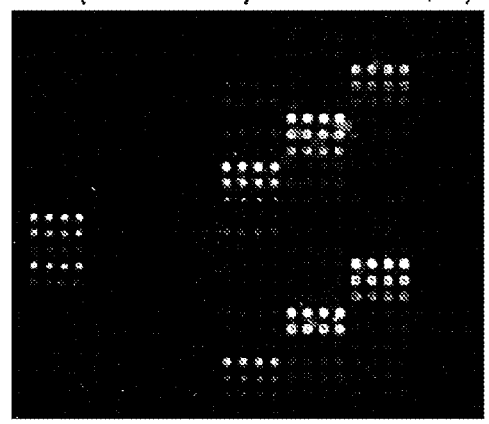
Figure 1E:
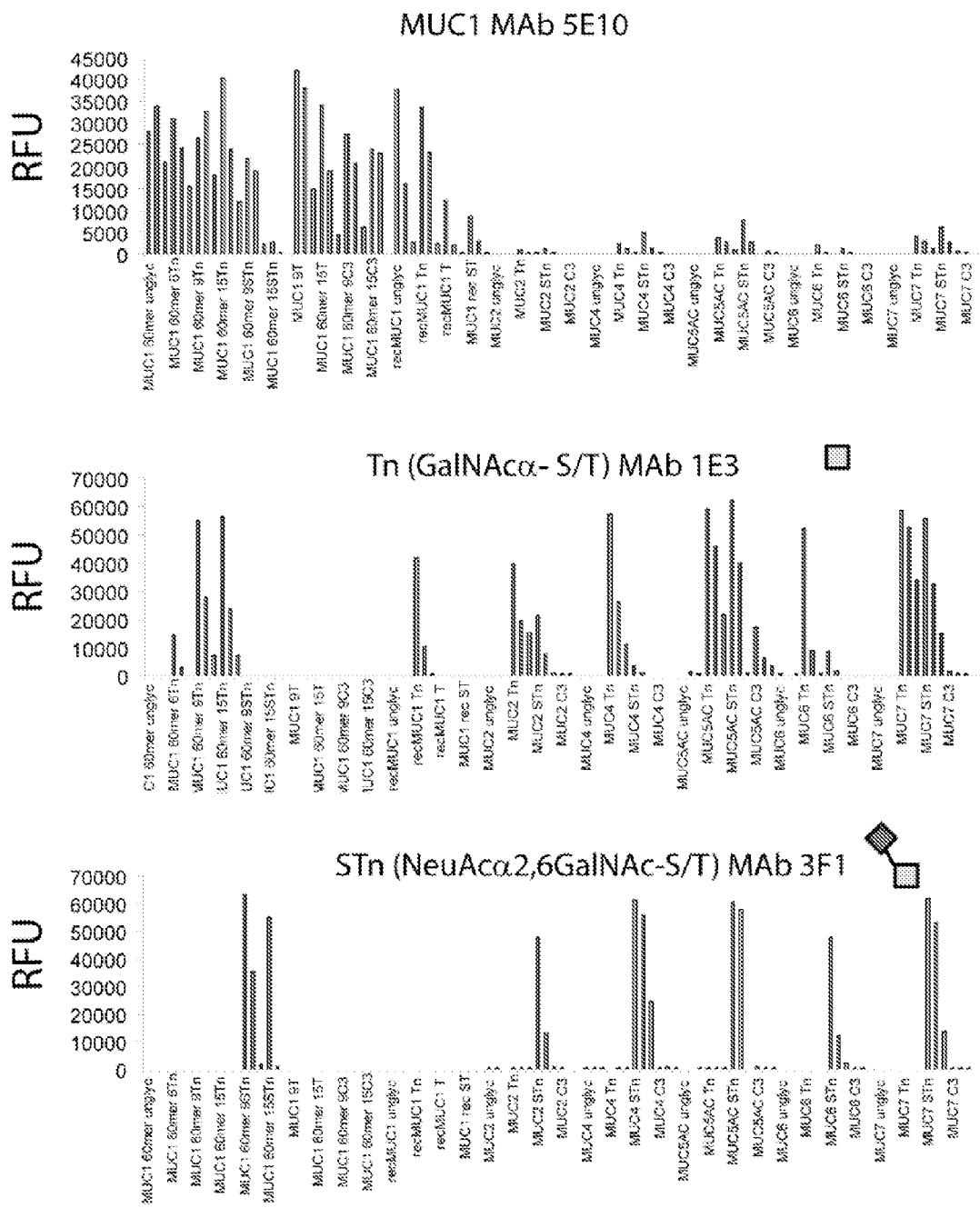

We first generated a comprehensive glycopeptide mucin array covering domains from MUC1, MUC2, MUC4, MUC5AC, MUC6 and MUC7 carrying cancer associated glycans Tn, Sialyl-Tn and truncated Core3. Next targets selective identified The MUC1 tandem repeat was represented by 60mer synthetic peptides as well as recombinant protein. In order to cover multiple potential epitopes in the large mucin proteins we produced recombinant fragments of MUC2, MUC4, MUC5AC, MUC6, and MUC7 by a simple and robust E. coli expression system. The mucin fragments were glycosylated with a combination of recombinant GalNAc-transferases (GalNAc-T1-4) yielding glycosylation products with high density of GalNAc addition comparable to what is expected in cancer cells. Further elongation of the Tn-glycoforms with sialyltransferase ST6GalNAc-T1 (to synthesize STn) and 133GlcNAc-T6 (to synthesize Core-3) yielded near complete glycosylation of all fragments as verified by SDS-PAGE and MALDI-TOF spectrometry (FIG. 7). The integrity of the printed mucin structures was verified by consistent labelling with mAbs to MUC1 (HMFG2), T7-tag, Tn (GalNAc-α-S/T)(1E3/5F4), and STn (NeuAcα2,6GalNAc) (FIG. 1D. Some residual Tn reactivity was detected in sialylated and Core-3 elongated glycosylation products, which was expected due to the very high density of Tn structures on the recombinant proteins. Purification of each glycosylation product followed by re-glycosylation with ST6GalNAc-1 or Core-3 synthase did not prevent such Tn exposure, excluding that the incomplete Tn-elongation was due to impurities and accumulation of by-products during in vitro glycosylation. Quality control of the microarrays was ensured by the inclusion a positive cancer sample as standard in each array analysis. The CV (coefficient of the variation) value differed between target compounds. For the targets of interest, however, it was less than 10%.

Figure 3D:
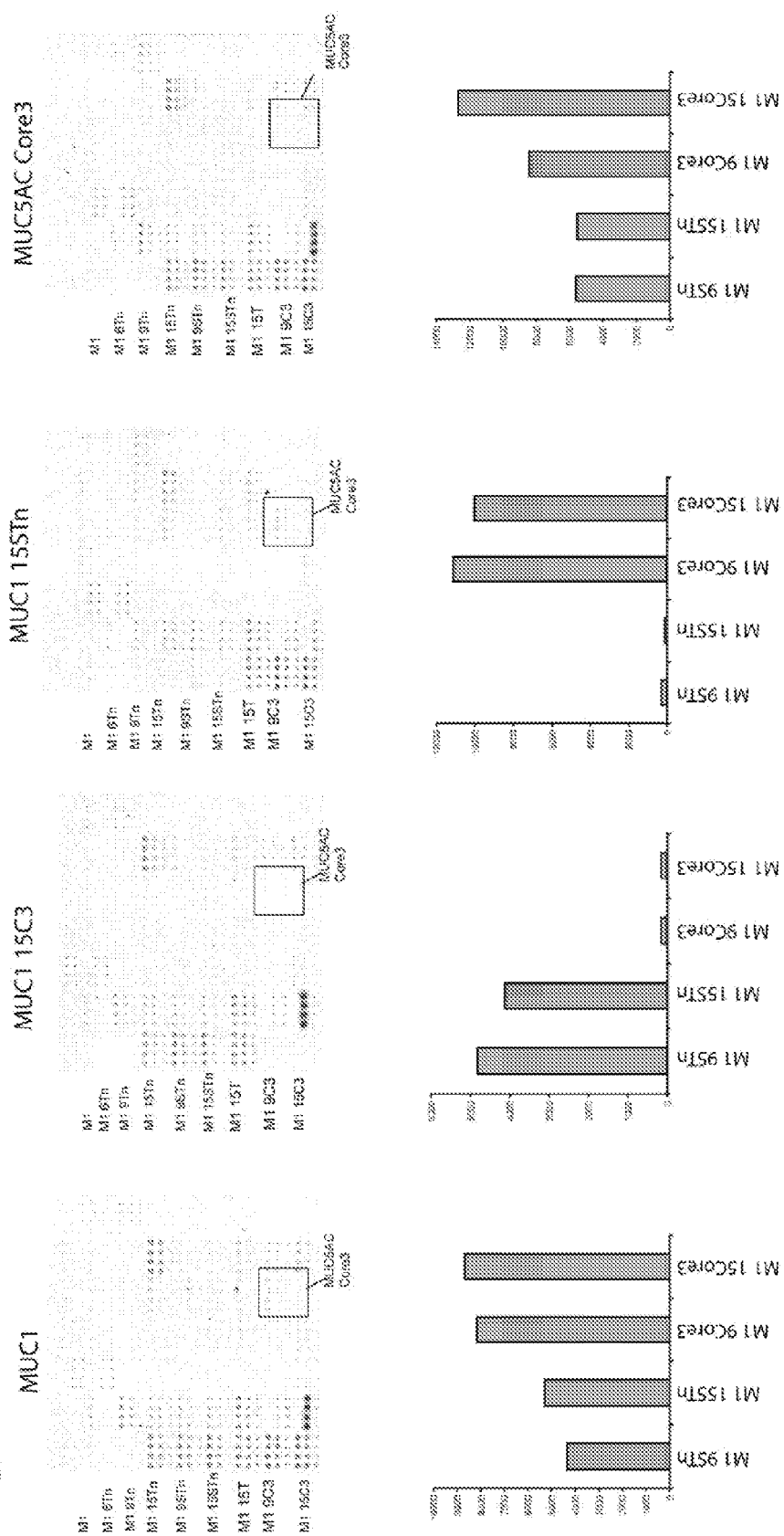

IgG Auto-Antibodies Recognizing Cancer Associated Glycans in Combination with MUC1 Peptide Backbone as Biomarkers in Serum The development of the glycopeptide mucin array allowed us to test for the presence of auto-antibodies in newly diagnosed patients with colorectal cancer (n=58) and healthy controls n=50 (FIG. 2). To our surprise we did not detect any significant IgG signature unambiguously identifying colorectal cancer patients from healthy individuals with the either non-glycosylated or glycosylated (Tn-, STn-, and truncated Core-3) recombinant mucin fragments (MUC2, MUC4, MUC5AC, MUC6, and MUC7) (FIG. 8). In contrast specific IgG auto-antibodies against Tn-MUC1, STn-MUC1 or truncated Core-3-MUC1 glycopeptide epitopes were identified in colorectal cancer patients (FIGS. 2 and 3A), with none or very low level of reactivity in healthy individuals. The reactivity with Tn-MUC1, STn-MUC1 or truncated Core-3-MUC1 glycopeptide epitopes were very homogeneous and the mean IgG reactivity expressed as fluorescence intensity was used to define the cut-off level for each glyco-peptide target. A serum sample was determined as positive if the fluorescent reactivity with a given glyco-peptide target was higher than three times the SD above the mean of the values obtained with sera from the healthy group. By this definition 74.1% of colorectal cancer patients had circulating antibodies towards either non-glycosylated, Tn, STn-, or Core3-glycosylated MUC1 (FIGS. 2 and 3, Table I). The most selective of the three antibody targets was STn-MUC1, which detected 56.7% (33/58) cancer patients, while Tn-MUC1 detected 39.7 (23/58) and Core3-MUC1 antibodies 44.8% (26/58). For comparison 0-2% healthy individuals tested positive on the different glycoforms of MUC1. An extra set of controls (n=50) were analyzed using these parameters. 2% (1/50) of these controls tested positive for STn-MUC1 antibodies, (1/50) for Tn-MUC1, and (1/50) for Core-3-MUC1 antibodies (FIG. 2,3A, Table I). Importantly these results were confirmed with both synthetic peptides covering the MUC1 repeat as well as recombinant MUC1. The induced antibodies did not cross-react with Tn or STn haptens as evidenced by lack of reactivity with other Tn and STn-glycopeptides. In sera from a few cancer patients (4/58; 6.9%) minimal reactivity with non-glycosylated MUC1 was detected, similar to the levels previously reported in breast cancer (von Mensdorff-Pouilly, Petrakou et al. 2000). Tn- and STn-MUC1 glycopeptides with at least two O-glycans in the immunodominant -GSTAP- epitope, i.e. 9 and 15 Tn -MUC1 (with two O-glycans in the -GSTAP- epitope) detected substantially more cancer patients than 6Tn-MUC1 (with one O-glycan in the -GSTAP- epitope). In particular glycopeptides with five glycans per repeat (VTSAPDTRPAPGSTAPPAHG) detected a higher number of colorectal cancer patients than glycoforms with three glycans per repeat (V TSAPDTRPAPGSTAPPAHG) (FIG. 2, Table I). This indicates that a considerable number of patients had auto-antibodies directed against the glycosylated PDTR epitope and/or the additional epitope formed by two GalNAc in the -VTS- region of the MUC1 repeat. To define the specificity of the cancer induced auto-antibodies we analyzed serum reactivity with MUC1 peptides carrying GalNAc, STn, and Core-3 at specific glycosylation sites (Table I). The majority of the cancer patients demonstrated their main reactivity with -GST- epitope (82% n/n), which corresponds with the finding that 15 STn/Tn/Core-3-MUC1 60mer peptide was the best target antigen (Table I). Some patients demonstrated polyclonal responses with additional reactivity against the glycosylated -PDTR- epitope (14%) and -VST- epitope (4%).

Glycoform Specificity of MUC1 Auto-Antibodies Discriminates Between Colorectal Cancer and Inflammatory Bowel Disease An inherent problem with many cancer markers identified to date is their lack of discrimination between cancer disease and inflammatory lesions causing benign diseases to be identified as cancer. Based on variations in glycan expression by cancer and inflammatory lesions we hypothesized that glycoform specificities of MUC1 auto-antibodies could distinguish between patients with colorectal cancer and chronic inflammatory bowel disease (IBD). Sera from patients diagnosed with Ulcerative Colitis or Crohn's disease in either active or remission state were therefore included in the study for comparison. In accordance with our hypothesis the cancer specific STn-MUC1 antibody response detected in 56.9% (33/58) of the colorectal cancer patients was only detected in 5.9% of IBD patients (FIG. 2,3 and Table I). This is in agreement with previous findings that tissue expression of the STn epitope is solely associated with dysplasia and colorectal cancer in IBD patients (Itzkowitz, Bloom et al. 1990). In contrast we found significant signals for auto-antibodies to Core-3-MUC1 28.2%) (FIG. 2A and Table I). When searching for the existence of auto-antibodies for the remaining mucin fragments we observed a higher reactivity to the MUC4, MUC5AC and MUC6 in the IBD population compared with healthy and cancer patients, although this was not-significant.

Characterization of MUC1 Glyco-Peptide Auto-Antibodies

In order to verify the selective nature of the identified auto-antibodies and eliminate cross-reactivity of the glycopeptide antibodies inhibition studies were performed. The cancer specific serum reactivity to STn-MUC1 and Core-3-MUC1 was selectively inhibited by 40 μg/mL of the respective MUC1 glycopeptides STn-MUC1 and Core3-MUC1 (FIG. 3B). Importantly, the reactivity of other mucins and glycoforms was left uninhibited. Only slight inhibition of the Core3-MUC1 reactivity was seen with free carbohydrate GlcNAc confirming that the peptide context of the carbohydrate structure plays an essential role. The selective nature of the cancer generated glycopeptides-MUC1 antibodies was additionally verified by pull-down assays with recombinant Tn-, STn, Core-3-MUC1 coupled to Dynabeads® (FIG. 9). The affinity purified serum IgG antibodies selectively reacted with the respective glycoform of MUC1, while the reactivity was diminished in the depleted serum. In accordance with previous findings, IgM antibodies purified on Core-3-MUC1-beads revealed hapten specificity reacting with all mucins carrying Core3. We finally determined the subclass of a subset of the circulating auto-antibodies in cancer patients reactive with STn- and Core3-MUC1. Interestingly these were mainly (68%) of the $IgG_2$ subclass along with 23% of the patients having $IgG_3$ and 9% having $IgG_{1/3/4}$.

To explain the large interpersonal variance in auto-antibody levels we next examined the presence of measurable cellular response against MUC1 in a separate cohort of patients. For this purpose we used peptide pools that represented T cell epitopes from the whole peptide backbone of MUC1. However, no MUC1 specific CD4+ or CD8+ T cells could be identified. Another possibility for interpersonal variations could be variable presence of circulating antigen. To correlate the presence of circulating MUC1 in cancer patients with the presence of auto-antibodies we next employed a capture ELISA strategy using the mAb HMFG2 recognizing all-glycoforms of MUC1. Although, various MUC1 glycoforms secreted from cancer cell lines (T47D) were readily detected by this method (Wandall 2009), the inventors could not detect any circulating MUC1 in colorectal cancer patients. This is in accordance with the lack of MUC1 detection using the commercial available CA 15-3 assay (Gebauer, Jager et al. 1998), and suggests that most secreted MUC1 is selectively cleared from the circulation.

IgA Autoantibody Signatures Against Tn-MUC4 Aid Selective Detection of Colorectal Cancer Because of the large quantities of IgA produced in the colon we next extended our analysis to test for the presence of auto-antibodies of the IgA subclass. The rationale for this approach was the known down-regulation of epithelial transcytosis of polymeric IgA in colon carcinomas mediated by the polymeric immunoglobulin receptor (pIgR) and loss of cellular polarity in the carcinoma cells. The combined effect of these events would be expected to increase circulating IgA specific for relevant cancer targets (Kaetzel 2005) (Baseler, Maxim et al. 1987). In accordance with the hypothesis, we detected increased levels of IgA auto-antibodies targeting the GalNAc glycosylated recombinant MUC4 fragment (Tn-MUC4) or non-glycosylated MUC4 in 75% of colorectal cancer. This finding was MUC4 specific. In contrast IgA auto-antibody reactivity to membrane mucin MUC1 and secreted mucins MUC2, MUC5AC, MUC6, and MUC7 could not be used to discriminate between colon cancer patients and healthy individuals. To evaluate if the IgA auto-antibody responses to MUC4 were due to a single immunodominant epitope or the collective reactivity of a polyclonal immune-responses, we analyzed overlapping glycopeptides covering the recombinant fragment of MUC4 with the inclusion of an additional set of 20mer MUC4 peptides covering the MUC4 tandem repeat area. The immune response against MUC4 had a polyclonal nature. However, up to 30% of the colorectal cancer patients had IgA autoantibodies to a single MUC4 tandem repeat peptide (TRM4-5; PVTYASSASTGDTTPLPVTDTSSVSTGHAT), with the majority of these patients having glycopeptide specific responses to GalNAc-glycosylated MUC4 tandem repeat peptide (FIG. 4, C). Apart from the immunodominant Tn-TRM4-5 glycopeptide, each cancer patient regognised different peptide and glyco-peptide epitopes among the remaining MUC4 targets. In order to compile results obtained with all MUC4 peptides, the values obtained for each target were expressed as the number of SD above the mean values from healthy patients. Thereby, a multiplex result was constructed, which demonstrated that 79.3% of cancer patients had detectable IgA MUC4 antibodies with cut-off values elected to be five times the SD of the mean of values from healthy patients to ensure high specificity. Importantly, the level of IgA reactivity was much lower in patients with inflammatory bowel disease (FIG. 4). We next tested IgA levels against MUC4 in serum from patients with other cancer than colorectal (prostate, ovarian, breast). A significantly portion of the patients had IgA auto-antibodies against epitopes outside the tandem repeat, but only little reactivity to the tandem-repeat region (7.1%) compared with the colorectal cancer group (55.1%).

Generation of Glycopeptide Specific Antibodies to MUC1 and MUC4 Glycopeptides

Figure 5B:
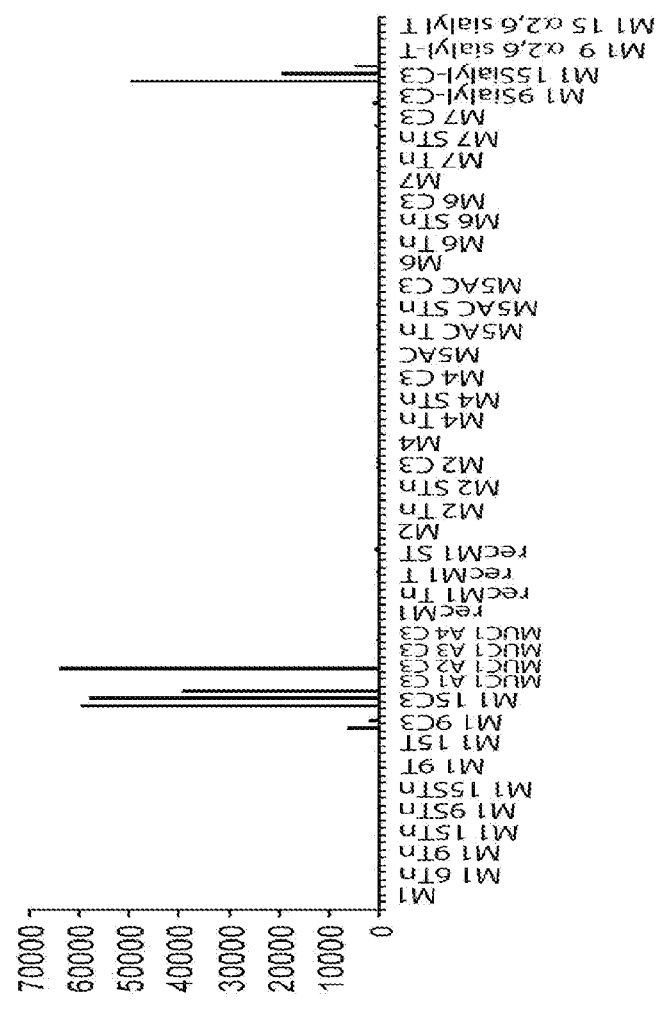
Figure 5B:
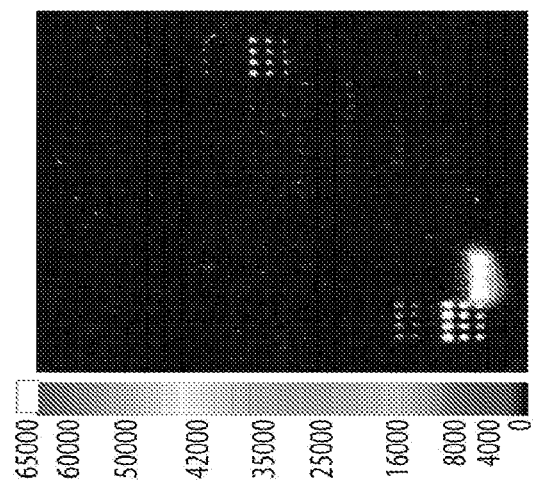
Figure 5D:
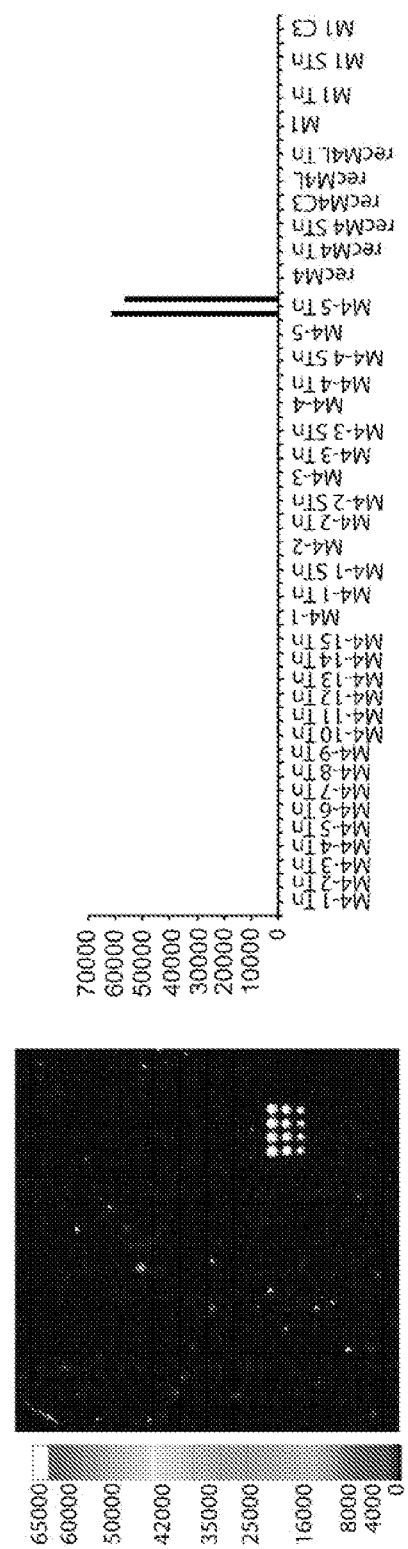
Figure 5F:
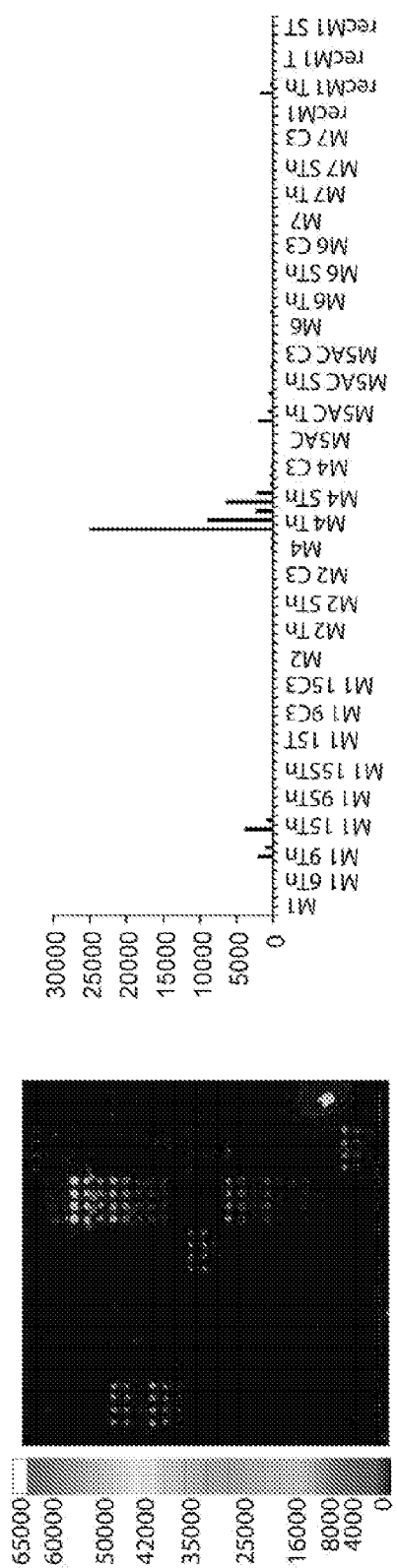

Two of the identified immodominant MUC1 glycopeptides (Tn-MUCI and STn-MUC1) has previously been shown to override tolerance in humans and humanized mice with the generation of potent monoclonal antibodies (5E5 and 2D9) specific for combined glycopeptide epitopes (Sorensen, Reis et al. 2006) (Tarp, Sorensen et al. 2007). In the present study we tested if the novel identified immunodominant glycopeptides Core3-MUC1 and the two different Tn-MUC4 targets (Tn-recMUC4 and Tn-MUC4TR5) induced immune-responses in wild type mice enabling generation of glycopeptides specific monoclonal antibodies. 60mer MUC1-Core3 glycopeptide with complete O-glycan occupancy and conjugated to KLH elicited strong polyclonal antibody response in Balb/c mice reacting with fully glycosylated Core3-MUC1 as demonstrated by ELISA (FIG. 5). A monoclonal antibody was produced with specificity for MUC1 carrying the Core-3 structure in T in -PDTR- in the MUC1 tandem repeat as analyzed by ELISA and array presenting mucins with cancer associated glycans. Reactivity was detected with Sialylated-Core3 as demonstrated by array analysis (FIG. 5C-E). No cross reactivity was detected with non-Core3-based structures or with other mucins carrying Core-3. In the same way, we tested the immunogenicity of Tn-MUC4rec and Tn-MUC4TR5-KLH. In both cases a prominent immuneresponse specific for Tn-MUC4 was generated in Balb/c mice (FIG. 5, Panel I). A monoclonal antibody 6E3 was generated using Tn-MUC4rec as immunogen. Elisa and array analysis demonstrated strong reactivity with Tn-MUC4 (FIG. 5I-L). No reactivity was seen with non-glycosylated peptide, while some cross-reactivity was noted with Tn-MUC1. Both the monoclonal antibody 6E3 and the polyclonal sera from mice immunized with Tn-MUC4TR stained HT29 and LSC cells known to express Tn-MUC4 due to disrupted cosmc and hence T-synthase function. No reaction was seen with cells not expressing MUC4. These findings confirm the immunogenic nature of the glycopeptides identified as targets in the screen for autologous antibodies and provide valuable tools for studying the expression of such glycopeptide epitopes in human cancer and inflammatory lesions.

Tissue Expression of Immunodominant MUC1 and MUC4 Glycopeptide Epitopes in Colorectal Cancer and Inflammatory Bowel Disease Using the developed glycopeptide specific antibodies we next tested the expression of Tn/STn-MUC1, Core3-MUC1, Tn-MUC4 in healthy tissue, tissue from inflammatory bowel patients and cancer patients. Examination of 25 cases of colorectal adenocarcinomas for the expression of Tn-, STn, and Core-3 MUC1 was performed with the well-characterized mAbs HMFG2, 5E5 and 2D9 with specificity for non-glycosylated MUC1, Tn- and STn-MUC1 respectively (Sorensen, Reis et al. 2006; Tarp, Sorensen et al. 2007). Core-3-MUC1 and Tn-MUC4 expression was analyzed with the novel Core3-MUC1, Tn-MUC4 mAbs (5C10, 6E3) respectively. 92% (23/25) of the cancer cases were positive, with between 20-90% of the cancer cells staining bright positive. Intensive labelling of intracellular structures as well as the luminal surface of cancer cells were seen with mAbs HMFG2, 5E5, 5C10, and 2D9 verifying the presentation of large amounts of Tn-, STn, and Core3-MUC1 on cancer cells. Importantly, apparent healthy neighbouring tissue had substantial lower expression levels, although a supranuclear staining pattern were seen in most cells.

ADCC 6E3

Peripheral blood mononuclear cells (PBMC) were isolated from the blood of healthy donors by density centrifugation with Lymphoprep (Nycomed Pharma Diagnostics, Oslo, Norway). The blood was diluted 1:2 in PBS with 0.5% FBS and was gently poured down the side of 50 ml tubes containing 15 ml Lymphoprep. After centrifugation at 2000 rpm in 20 min, the layer containing PBMCs was transferred to a new tube, washed, and resuspended in RPMI 1640 before eosin staining for evaluation of viability.

ADCC were tested using a standard 51Cr release assay. Target cells were loaded with 100 µCi 51Cr (PerkinElmer) for 1 h at 37° C., and washed in culture media×5, and plated at 1×104 per well in a 96-well flat-bottom plate before incubation for 1 hour with antibody before addition of effector cells. After 4 hours of incubation at 37° C., 30 of supernatant was removed from each well and plated on a LumaPlate-96, dried down, and counted on a Packard's TopCount®.

The results demonstrated in FIG. 13 are expressed as the percentage of specific release calculated by following equation: (experimental release−spontaneous release×100)/(maximal release−spontaneous release), where the spontaneous release represents the mean cpm for target cells incubated without antibody and immuneeffectors, and the maximal release represents the mean cpm for target cells incubated with 30% ethanol.

P53 Array Print and Analysis.

15 mer peptides with 10 amino acid overlap representing the whole p53 protein backbone and control structures were printed on Schott Nexterion® Slide H or Schott Nexterion® Slide H MPX 16 (Schott A G, Mainz, Germany). Quadruplicates of all compounds were printed at 200 and 50 µM in 150 mM sodium phosphate pH 8.5 with 0.005% CHAPS and printed on a BioRobotics MicroGrid II spotter (Genomics Solution) with a 0.21 mm pitch using Stealth 3B Micro Spotting Pins (Telechem International Arraylt Division). After printing, slides were incubated for 1 h in a humidified hybridization chamber with 75% relative humidity and stored until use at −20° C. Prior to use unspotted slide areas were blocked for 1 h with 25 mM ethanolamine in 100 mM sodium borate pH 8.5. Human sera serially diluted 1:25 and were incubated in a closed container with gentle agitation for 1 h, washed three times in PBS with 0.05% Tween-20 (PBS-T), followed by 1 h incubation with appropriate secondary antibodies. Human IgG antibodies were detected with Cy3-conjugated goat anti-human IgG (Fc specific) diluted 1:5000 in PBS-T. After incubation with secondary antibodies the slides were washed 3 times in PBS-T, and after the final wash, slides were rinsed shortly in $H_2O$, dried by centrifugation (200×g) and scanned in a ProScanArray HT Microarray Scanner (PerkinElmer) followed by image analysis with ProScanArray Express 4.0 software (PerkinElmer). Each spot were done in 4 replicates and the mean value of relative fluorescence intensity (RFU) was used. For comparison, slides were scanned with identical scanning parameters. Data were analyzed and plotted using Microsoft Excel or Graph Pad Prism software. A total of 78 15mer peptides were printed. 18 peptides p53 peptides (number: 4, 5, 9, 10, 14, 25, 26, 27, 34, 39, 41, 42, 43, 44, 45, 58, 59, and 78) had had sensitivity over 10% with specificity 95%. 19 out of 58 colorectal cancer patients had autoantibodies to peptide 34. Combining the p53-34 with MUC1STn increased the sensitivity from 57% to 72%; a combination of p53-34, p53-44, and MUC1 STn increased the sensitivity to 79% with a specificity of 94%. The results are demonstrated in FIG. 15.

TABLE I

IgG Auto-antibodies to selected MUC1 glycopeptides
Percentage of healthy controls, IBD patients and colorectal cancer patients with auto-antibodies to MUC1 glycopeptides.
A positive test is defined as 3 standard deviation over the mean of the healthy controls. Combined results with two or three glycopeptides are also shown.

| Glycopeptide | Controls | IBD | CRC |
|---|---|---|---|
| MUC1 | 4% (2/50) | 2.6% (1/39) | 6.9% (4/58) |
| MUC1 6Tn | 2% (1/50) | 5.1% (2/39) | 20.7% (12/58) |
| MUC1 9Tn | 2% (1/50) | 5.1% (2/39) | 20.7% (12/58) |
| MUC1 15Tn | 2% (1/50) | 15.4% (6/39) | 39.7% (23/58) |
| MUC1 9Core3 | 2% (1/50) | 17.9% (7/39) | 27.6% (16/58) |
| MUC1 15Core3 | 0% (1/50) | 20.5% (8/39) | 44.8% (26/58) |
| MUC1 9STn | 2% (1/50) | 7.7% (3/39) | 41.4% (23/58) |
| MUC1 15STn | 2% (1/50) | 10.3% (4/39) | 56.9% (33/58) |
| MUC1 9C3 or 15C3 | 2% (1/50) | 28.2% (11/39) | 44.8% (26/58) |
| MUC1 STn or C3 | 4% (2/50) | 33% (13/39) | 63.8% (37/58) |
| MUC1 Tn or STn or C3 | 8% (4/50) | 38.5% (15/39) | 74.1% (43/58) |

TABLE II

IgA Auto-antibodies to selected MUC4 glycopeptides
Percentage of the healthy controls, IBD patients, colorectal
cancer patients, and a combined group of prostate, ovarian
and breast cancer patients with IgA auto-antibodies to
different MUC4 glycopeptides. A positive test is defined as
5 standard deviation over the mean of the healthy controls.
Combined results with two or more glycopeptides are also shown.

| Glycopeptide | Controls | IBD | CRC | Prostate, Ovarian and Breast cancer |
|---|---|---|---|---|
| MUC4 | 0% | 2.6% (1/39) | 29.3% (17/58) | 3.6% (1/28) |
| MUC4 Tn | 0% | 7.7% (3/39) | 37.9% (22/58) | 7.1% (2/28) |
| MUC4 non glycosylated or Tn | 0% | 7.7% (3/39) | 55.1% (32/58) | 7.1% (2/28) |
| MUC4s fragments | 0% | 17.9% (7/39) | 41.4% (24/58) | 35.7% (10/28) |
| MUC4s fragments Tn | 0% | 7.7% (3/39) | 29.3% (17/58) | 57.1% (16/28) |
| All Tn-MUC4 | 0% | 7.7% (3/39) | 53.4% (31/58) | 57.1% (16/28) |
| recMUC4s | 0% | 2.6% (3/39) | 3.4% (2/58) | 7.1% (2/28) |
| recMUC4s Tn | 0% | 2.6% (3/39) | 13.8% (8/58) | 32.1% (9/28) |
| MUC1Tn, STn, C3 MUC4 Tn, TR | 8% | 43.6% (17/39) | 87.9% (51/58) | |
| MUC1STn + MUC4 | 2% | 15.4% (6/39) | 82.8% (48/58) | |

TABLE III

Legend to glycopeptide sequences of Table II

| | |
|---|---|
| MUC4 | (PVTSPSSASTGHTTPLPVTDTSSASTGDTTP) <br> (LPVTSLSSVSTGDTTPLPVTSPSSASTGH) <br> (LPVTSPSSASTGHASPLLVTDASSASTGQ) <br> (STGDTLPLPVTDTSSV) <br> (PVTYASSASTGDTTPLPVTDTSSVSTGHAT) |
| MUC4 Tn | (PVT*S*PS*S*AS*T*GHT*T*PLPVT*DT*S*S*AS*T*GDT*T*P) <br> (LPVT*S*LS*S*VS*T*GDT*T*PLPVT*S*PS*S*AS*T*GH) <br> (LPVT*S*PS*S*AS*T*GHAS*PLLVT*DAS*S*AS*T*GQ) <br> (S*T*GDT*LPLPVT*DT*S*S*V) <br> (PVT*YAS*S*AS*T*GDT*T*PLPVT*DT*S*S*VS*T*GHAT*) |
| MUC4 non glycosylated or Tn | (PVTSPSSASTGHTTPLPVTDTSSASTGDTTP) <br> (LPVTSLSSVSTGDTTPLPVTSPSSASTGH) <br> (LPVTSPSSASTGHASPLLVTDASSASTGQ) <br> (STGDTLPLPVTDTSSV) <br> (PVTYASSASTGDTTPLPVTDTSSVSTGHAT) <br> (PVT*S*PS*S*AS*T*GHT*T*PLPVT*DT*S*S*AS*T*GDT*T*P) <br> (LPVT*S*LS*S*VS*T*GDT*T*PLPVT*S*PS*S*AS*T*GH) <br> (PLPVT*S*PS*S*AS*T*GHAS*PLLVT*DAS*S*AS*T*GQ) <br> (S*T*GDT*LPLPVT*DT*S*S*V) <br> (PVT*YAS*S*AS*T*GDT*T*PLPVT*DT*S*S*VS*T*GHAT*) |
| MUC4s fragments | PMTDTKTVTTPGSSFTA (SEQ ID NO: 3), <br> PGSSFTASGHSPSEIVPQD (SEQ IDNO: 4), <br> SEIVPQDAPTISAATTFAPA (SEQ IDNO: 5), <br> TTFAPAPTGNGHTTQAPTTA (SEQ ID NO: 6), <br> TTQAPTTALQAAPSSHD (SEQ ID NO: 7), <br> APSSHDATLGPSGGTSLSKT (SEQ ID NO: 8), <br> SLSKTGALTLANSVVSTP (SEQ ID NO: 9), <br> NSVVSTPGGPEGQWTSASAS (SEQ IDNO: 10), <br> TSASASTSPRTAAAMTHT (SEQ ID NO: 11), <br> AAAMTHTHQAESTEASGQT (SEQ ID NO: 12), <br> EASGQTQTSEPASSGSRTT (SEQ ID NO: 13) <br> 13),PASSGSRTTSAGTATPSSS (SEQ ID NO: 14), <br> TATPSSSGASGTTPSGSEGI (SEQ ID15 NO: 15), <br> GSEGISTSGETTRFSSN (SEQ ID NO: 16), <br> GETTRFSSNPSRDSHTT (SEQ ID NO: 17) |
| MUC4s fragments Tn | PMT*DT*KT*VT*T*PGS*S*FT*A (SEQ ID NO: 3), <br> PGS*S*FT*AS*GHS*PS*EIVPQD (SEQ ID NO: 4), <br> S*EIVPQDAPT*IS*AAT*T*FAPA (SEQ IDNO: 5), <br> T*T*FAPAPT*GNGHT*T*QAPT*T*A (SEQ ID NO: 6), <br> T*T*QAPT*T*ALQAAPS*S*HD (SEQ ID NO: 7), <br> APS*S*HDAT*LGPS*GGT*S*LS*KT* (SEQ ID NO: 8), <br> S*LS*KT*GALT*LANS*VVS*T*P (SEQ ID NO: 9), <br> NS*VVS*T*PGGPEGQWT*S*AS*AS* (SEQ IDNO: 10), <br> T*S*AS*AS*T*S*PRT*AAAMT*HT* (SEQ ID NO: 11), |

TABLE III -continued

| Legend to glycopeptide sequences of Table II |
|---|

```
                AAAMT*HT*HQAES*T*EAS*GQT* (SEQ ID NO: 12),
                EAS*GQT*QT*S*EPAS*S*GS*RT*T* (SEQ ID NO: 13),
                PAS*S*GS*RT*T*S*AGT*AT*PS*S*S* (SEQ ID NO: 14),
                T*AT*PS*S*S*GAS*GT*T*PS*GS*EGI (SEQ ID15 NO: 15),
                GS*EGIS*T*S*GET*T*RFS*S*N (SEQ ID NO: 16),
                GET*T*RFS*S*NPS*RDS*HT*T* (SEQ ID NO: 17)

All Tn-MUC4     (PVT*S*PS*S*AS*T*GHT*T*PLPVT*DT*S*S*AS*T*GDT*T*P)
                (LPVT*S*LS*S*VS*T*GDT*T*PLPVT*S*PS*S*AS*T*GH)
                (PLPVT*S*PS*S*AS*T*GHAS*PLLVT*DAS*S*AS*T*GQ)
                (S*T*GDT*LPLPVT*DT*S*S*V)
                (PVT*YAS*S*AS*T*GDT*T*PLPVT*DT*S*S*VS*T*GHAT*)
                (PMT*DT*KTV*T*T*PGS*S*FT*AS*GHS*PS*EIVPQDAPT*IS*AAT*Z
                FAPAPT*GNGHT*T*QAPT*T*ALQAAPS*S*HDAT*LGPS*GGT*S*LS*
                KT*GALT*LANS*VVS*T*PGGPEGQWT*S*AS*AS*T*S*PDT*AAAMT*
                HT*HQAES*T*EAS*GQT*QT*S*EPAS*S*GS*RT*T*S*AGT*AT*PS*S
                *S*GAS*GT*T*PS*GS*EGIS*T*S*GET*T*RFS*S*NPS*RDS*HT*T*)
                PMT*DT*KT*VT*T*PGS*S*FT*A (SEQ ID N0: 3),
                PGS*S*FT*AS*GHS*PS*EIVPQD (SEQ ID NO: 4),
                S*EIVPQDAPT*IS*AAT*T*FAPA (SEQ ID NO: 5),
                T*T*FAPAPT*GNGHT*T*QAPT*T*A (SEQ ID NO: 6),
                T*T*QAPT*T*ALQAAPS*S*HD(SEQ ID NO: 7),
                APS*S*HDAT*LGPS*GGT*S*LS*KT* (SEQ ID NO: 8),
                S*LS*KT*GALT*LANS*VVS*T*P (SEQ ID NO: 9),
                NS*VVS*T*PGGPEGQWT*S*AS*AS* (SEQ IDNO: 10),
                T*S*AS*AS*T*S*PRT*AAAMT*HT* (SEQ ID NO: 11),
                AAAMT*HT*HQAES*T*EAS*GQT*(SEQ ID NO: 12),
                EAS*GQT*QT*S*EPAS*S*GS*RT*T* (SEQ ID NO: 13),
                PAS*S*GS*RT*T*S*AGT*AT*PS*S*S* (SEQ ID NO: 14),
                T*AT*PS*S*S*GAS*GT*T*PS*GS*EGI (SEQ ID15 NO: 15),
                GS*EGIS*T*S*GET*T*RFS*S*N (SEQ ID NO: 16),
                GET*T*RFS*S*NPS*RDS*HT*T* (SEQ ID NO: 17)

Recombinant     (PMTDTKTVTTPGSSFTASGHSPSEIVPQDAPTISAATZFAPAPTGN
MUC4s           GHTTQAPTTALQAAPSSHDATLGPSGGTSLSKTGALTLANSVVSTP
                GGPEGQWTSASASTSPDTAAAMTHTHQAESTEASGQTQTSEPAS
                SGSRTTSAGTATPSSSGASGTTPSGSEGISTSGETTRFSSNPSRDS
                HTT)

Recombinant     (PMT*DT*KT*VT*T*PGS*S*FT*AS*GHS*PS*EIVPQDAPT*IS*AAT*Z
MUC4s Tn        FAPAPT*GNGHT*T*QAPT*T*ALQAAPS*S*HDAT*LGPS*GGT*S*LS*
                KT*GALT*LANS*VVS*T*PGGPEGQWT*S*AS*AS*T*S*PDT*AAAMT*
                HT*HQAES*T*EAS*GQT*QT*S*EPAS*S*GS*RT*T*S*AGT*AT*PS*S
                *S*GAS*GT*T*PS*GS*EGIS*T*S*GET*T*RFS*S*NPS*RDS*HT*T*)

MUC1Tn, STn,    (MUC1STn)
C3              VT(Tn)S(Tn)APDT(Tn)RPAPGS(Tn)T(Tn)APPAHG
MUC4 Tn         VT(STn)S(STn)APDT(STn)RPAPGS(STn)T(STn)APPAHG
                VT(Core3)S(Core3)APDT(Core3)RPAPGS(Core3)T(Core3)APPAHG
                MUC4
                (PVTSPSSASTGHTTPLPVTDTSSASTGDTTP)
                (LPVTSLSSVSTGDTTPLPVTSPSSASTGH)
                (LPVTSPSSASTGHASPLLVTDASSASTGQ)
                (STGDTLPLPVTDTSSV)
                (PVTYASSASTGDTTPLPVTDTSSVSTGHAT)
                (PVT*S*PS*S*AS*T*GHT*T*PLPVT*DT*S*S*AS*T*GDT*T*P)
                (LPVT*S*LS*S*VS*T*GDT*T*PLPVT*S*PS*S*AS*T*GH)
                (LPVT*S*PS*S*AS*T*GHAS*PLLVT*DAS*S*AS*T*GQ)
                (S*T*GDT*LPLPVT*DT*S*S*V)
                (PVT*YAS*S*AS*T*GDT*T*PLPVT*DT*S*S*VS*T*GHAT*)
                (PMT*DT*KTV*T*T*PGS*S*FT*AS*GHS*PS*EIVPQDAPT*IS*AAT*Z
                FAPAPT*GNGHT*T*QAPT*T*ALQAAPS*S*HDAT*LGPS*GGT*S*LS*
                KT*GALT*LANS*VVS*T*PGGPEGQWT*S*AS*AS*T*S*PDT*AAAMT*
                HT*HQAES*T*EAS*GQT*QT*S*EPAS*S*GS*RT*T*S*AGT*AT*PS*S
                *S*GAS*GT*T*PS*GS*EGIS*T*S*GET*T*RFS*S*NPS*RDS*HT*T*)
                PMT*DT*KT*VT*T*PGS*S*FT*A (SEQ ID NO: 3),
                PGS*S*FT*AS*GHS*PS*EIVPQD (SEQ ID NO: 4),
                S*EIVPQDAPT*IS*AAT*T*FAPA (SEQ IDNO: 5),
                T*T*FAPAPT*GNGHT*T*QAPT*T*A (SEQ ID NO: 6),
                T*T*QAPT*T*ALQAAPS*S*HD(SEQ ID NO: 7),
                APS*S*HDAT*LGPS*GGT*S*LS*KT* (SEQ ID NO:8),
                S*LS*KT*GALT*LANS*VVS*T*P (SEQ ID NO: 9),
                NS*VVS*T*PGGPEGQWT*S*AS*AS* (SEQ ID NO: 10),
                T*S*AS*AS*T*S*PRT*AAAMT*HT* (SEQ ID NO: 11),
                AAAMT*HT*HQAES*T*EAS*GQT* (SEQ ID NO: 12),
                EAS*GQT*QT*S*EPAS*S*GS*RT*T* (SEQ ID NO: 13),
                PAS*S*GS*RT*T*S*AGT*AT*PS*S*S* (SEQ ID NO: 14),
                T*AT*PS*S*S*GAS*GT*T*PS*GS*EGI (SEQ ID15 NO: 15),
```

TABLE III -continued

Legend to glycopeptide sequences of Table II

|  |  |
|---|---|
|  | GS*EGIS*T*S*GET*T*RFS*S*N (SEQ ID NO: 16), |
|  | GET*T*RFS*S*NPS*RDS*HT*T* (SEQ ID NO: 17) |
| MUC1STn + | MUC1STn |
| MUC4 | VT(STn)S(STn)APDT(STn)RPAPGS(STn)T(STn)APPAHG |
|  | MUC4 |
|  | (PVTSPSSASTGHTTPLPVTDTSSASTGDTTP) |
|  | (LPVTSLSSVSTGDTTPLPVTSPSSASTGH) |
|  | (LPVTSPSSASTGHASPLLVTDASSASTGQ) |
|  | (STGDTLPLPVTDTSSV) |
|  | (PVTYASSASTGDTTPLPVTDTSSVSTGHAT) |
|  | (PVT*S*PS*S*AS*T*GHT*T*PLPVT*DT*S*S*AS*T*GDT*T*P) |
|  | (LPVT*S*LS*S*VS*T*GDT*T*PLPVT*S*PS*S*AS*T*GH) |
|  | (LPVT*S*PS*S*AS*T*GHAS*PLLVT*DAS*S*AS*T*GQ) |
|  | (S*T*GDT*LPLPVT*DT*S*S*V) |
|  | (PVT*YAS*S*AS*T*GDT*T*PLPVT*DT*S*S*VS*T*GHAT*) |

SEQUENCE LISTING (69 sequences)

SEQ ID NO: 1 - protein, 2169 aa, Homo Sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 2 - protein, 1255 aa, Homo Sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 3 - protein, 17 aa, Homo Sapiens
PMTDTKTVTTPGSSFTA

SEQ ID NO: 4 - protein, 19 aa, Homo Sapiens
PGSSFTASGHSPSEIVPQD

SEQ ID NO: 5 - protein, 20 aa, Homo Sapiens
SEIVPQDAPTISAATTFAPA

SEQ ID NO: 6 - protein, 20 aa, Homo Sapiens
TTFAPAPTGNGHTTQAPTTA

SEQ ID NO: 7 - protein, 17 aa, Homo Sapiens
TTQAPTTALQAAPSSHD

SEQ ID NO: 8 - protein, 20 aa, Homo Sapiens
APSSHDATLGPSGGTSLSKT

SEQ ID NO: 9 - protein, 18 aa, Homo Sapiens
SLSKTGALTLANSVVSTP

SEQ ID NO: 10 - protein, 20 aa, Homo Sapiens
NSVVSTPGGPEGQWTSASAS

SEQ ID NO: 11 - protein, 18 aa, Homo Sapiens
TSASASTSPRTAAAMTHT

SEQ ID NO: 12 - protein, 19 aa, Homo Sapiens
AAAMTHTHQAESTEASGQT

SEQ ID NO: 13 - protein, 19 aa, Homo Sapiens
EASGQTQTSEPASSGSRTT

SEQ ID NO: 14 - protein, 19 aa, Homo Sapiens
PASSGSRTTSAGTATPSSS

SEQ ID NO: 15 - protein, 20 aa, Homo Sapiens
TATPSSSGASGTTPSGSEGI

SEQ ID NO: 16 - protein, 18 aa, Homo Sapiens
SGSEGISTSGETTRFSSN

SEQ ID NO: 17 - protein, 17 aa, Homo Sapiens
GETTRFSSNPSRDSHTT

SEQ ID NO: 18 - protein, 31 aa, Homo Sapiens
PVTSPSSASTGHTTPLPVTDTSSASTGDTTP

SEQ ID NO: 19 - protein, 29 aa, Homo Sapiens
LPVTSLSSVSTGDTTPLPVTSPSSASTGH

SEQ ID NO: 20 - protein, 29 aa, Homo Sapiens
LPVTSPSSASTGHASPLLVTDASSASTGQ

SEQ ID NO: 21 - protein, 30 aa, Homo Sapiens
PLPVTSPSSASTGHASPLLVTDASSASTGQ

SEQ ID NO: 22 - protein, 16 aa, Homo Sapiens
STGDTLPLPVTDTSSV

SEQ ID NO: 23 - protein, 30 aa, Homo Sapiens
PVTYASSASTGDTTPLPVTDTSSVSTGHAT

SEQ ID NO: 24 - protein, 20 aa, Homo Sapiens
VTSAPDTRPAPGSTAPPAHG

SEQ ID NO: 25 - protein, 33 aa, Homo Sapiens
PTTTPITTTTTVTPTPTPTGTQTPTTTPISTTC

SEQ ID NO: 26 - protein, 5179 aa, Homo Sapiens
MGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNAVVFKSDGSVLLNQLQVNLPHVTASFSVFRPSSYHIMVSMAIGVRLQVQLAPVMQLFVTLDQASQGQVQGLCGNFNGLEGDDFKTASGLVEATGAGFANTWKAQSTCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 27 - protein, 1373 aa, Homo Sapiens
MSVGRRKLALLWALALALACTRHTGHAQDGSSESSYKHHPALSPIARGPIGVPLRGATVFPSLRTIPVVRASNPAHNGRVCSTWGSFHYKTFDGDVFRFPGLCNYVFSEHCGAAYEDFNIPATPQPGVSGPHAEQGPHEGGWRGHPADQGLRPGQRPPGPAALQPVWGPHSARAAATPRWKPGWALSSCGTTMTACCWKLDTKYANKNLWALWGLQRDARGQRAPLPQHQADTHGIREPAERWTNPRSSVRTLSLNPRRTAPLALASCEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNEETASTRWCRTAVAGKTAPRTPFVLSPRTSPAAPQGPPAPRPSRFSWGNFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRT

SEQ ID NO: 28 - protein, 2392 aa, Homo Sapiens
MVQRWLLLSCCGALLSAGLANTSYTSPGLQRLKDSPQTAPDKGQCSTWGAGHFSTFDHHVYDFSGTCNYIFAATCKDAFPSFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARGCTQLLTLVAPECSVSKEPFVLSCQADVAAAPQPGPQNSSYATLSEYSRQCSMVGQPVALRSPGLCSVGQCPANQVYQECGSACVKTCSNSEHSCSSSCTFGCFCPEGTDLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPDALERETDPCSMSQLNKVCAETHCSMLLRTGTVFERCHATVNPAPIYKRCMYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRLQMFLASCQAPKTFKSCSQSSENKFGAACAPTCQMLATGVACVPTKCEPGCVCAEGLYENAYGQCVPPEECPCEFSGVSYPGGAELHTDCRTCSCSRGRWACQQGTHCPSTCTLYGEGHVITFDGQRFVFDGNCEYILATDVCGVNYSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMASSASNHSAPTGTIPPPTTLKATGSTHTAPPITPTTSGTSQAHSSFSTNKTPTSLHSHTSSTHHPEVTPTSTTSITPNPTSTRTRTPMAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTLTTSGTSQALSSLNTAKTSTSLHSHTSSTHHAEATSTSTTNITPNPTSTGTPPMTVTTSTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 29 - protein, 377 aa, Homo Sapiens
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNATTISSRENVNTSSSVATLAPVNSPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTITSVTTQTTTTKQPTSAPGQNKISRFLLYMKNLLNRIIDDMVEQ

SEQ ID NO: 30 - protein, 185 aa, Homo Sapiens
PMTDTKTVTTPGSSFTASGHSPSEIVPQDAPTISAATZFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTT

SEQ ID NO: 31 - protein, 103 aa, Homo Sapiens
MGSSHHHHHHSSGLVPRGSHMASMTGGQQMGRDPNSVTSAPDTRPAPGSTAPQAHGVTSAPDTRPAPGSTAPPAHGVTSAPDTRPAPGSTAPPAHGVTSAPDT

SEQ ID NO: 32 - protein, 118 aa, Homo Sapiens
MGSSHHHHHHSSGLVPRGSHMASMTGGQQMGRDPNSSSVDKLDIEFLQPGGSVQCCECVTQPTTMTTTTTENPTPTPITTTTTVTPTPTPTSTQSTTPTPITTTNTVTPTPTPTGTQT

SEQ ID NO: 33 - protein, 221 aa, Homo Sapiens
MGSSHHHHHHSSGLVPRGSHMASMTGGQQMGRIPTSSTTSTPQTSTTSASTTSITSGPGTTPSPVPTTSTTSAPTTSTTSAATTSTISAPTTSTTSAPTTSTTSASTASKTSGLGTTPSPIPTTSTTSPPTTSTTSASTASKTSGPGTTPSPVPTTSTIFAPRTSTTSASTTSTTPGPGTTPSPVPTTSTASVSKTSTSHVSISKTTHSQAAALEHHHHHH

SEQ ID NO: 34 - protein, 115 aa, Homo Sapiens
MGSSHHHHHHSSGLVPRGSHMASMTGGQQMGRIRSTSLVTPSTHTVITPTHAQMATSASNHSAPTGTIPPPTTLKATGSTHTAPPITPTTSGTSQAHSSFSTNKAAALEHHHHHH

SEQ ID NO: 35 - protein, 236 aa, Homo Sapiens
MGSSHHHHHHSSGLVPRGSHMASMTGGQQMGRIPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTTTSVTTQTTTTKQPTSAPAAALEHHHHHH

SEQ ID NO: 36 - protein, 2541 aa, Homo Sapiens
  misc_feature (341)..(350): Xaa can be any naturally occurring amino acid
  misc_feature (864)..(873): Xaa can be any naturally occurring amino acid
  misc_feature (888)..(888): Xaa can be any naturally occurring amino acid
  misc_feature (907)..(907): Xaa can be any naturally occurring amino acid
  misc_feature (1315)..(1324): Xaa can be any naturally occurring amino acid
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSSITSSITSTNTVTSMTTTASQPTATNTLSSPTRTILSSTPVLSTETITSGITNTTPLSTLVTTLPTTISRSTPTSETTYPTSPXXXXXXXXXXAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSHSTPSFTSSTIYSTVSTSTTAISSASPTSGTMVTSTTMTPSSLSTDTPSTTPTTITYPSVGSTGFLTTATDLTSTFTVSSSSAMSKSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLXXXXXXXXXXFTSSTSLLHSQHTTXLPSPSVPTTLGTMVTSTSXIPSSLSTDIPTSQPTTITPSSVGITGSLPMMTDLTSVYTVSSMSARPTSVIPSSPTVQNTETSIFVSMMSATTPSGGSTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTDSIVXXXXXXXXXXITITETTSHSTPSYTTSITTTETPSHSTPSYTTSITTTETPSHSTPSFTSSITTTETTSHSTPSFTSSIRTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSARSFTSSITTTETTSHNTRSFTSSITTTETNSHSTTSFTSSITTTETTSHSTPSFSSSITTTETPLHSTPGLPSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQTLCFKPDSIKVNNNSKTELTPEAICRRAAPTGYEEFYFPLVEATRLRCVTKCTSGVDNAIDCHQGQCVLETSGPACRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFHVALENVDTTMKVHIKRPEMTSSSV

SEQ ID NO: 37 - protein, 1224 aa, Homo Sapiens
  misc_feature (337)..(346): Xaa can be any naturally occurring amino acid
MQLLGLLSILWMLKSSPGATGTLSTATSTSHVTFPRAEATRTALSNSPHSRYLAEWPQGVPQLASPAPGHRENAPMTLTTSPHDTLISETLLSSLVSSNTSTTPTSKFAFKVETTPPTVLVYSATTECVYPTSFIITISHSTSICVTTTQVTFTSSYTPTPVTQKPVTTVTRTYPMTTTEKGTSAMISSPSTTTARETPIVTVTPSSSVSATDTTFHTTISSTTRTTERTPLPTGSIHTTMSPTPVFTTLKTAVTSTSPITSTITSTNTVTSMTTTTSRPTATNTLSSLTSSILSSTPAPNTEVITSHTTTTTPPSTLVTTLPTAIARSTPTSETTXXXXXXXXXXTIYSTVSSSTTAITSPFTTAETGVTSTPSSPSSLSTDIPTTSLRTLTPLSLSTSTSLTTTTDLPSIPTDISSLPTPIHIISSSPSIQSTETSSLVGTTSPTMSTVRATLRSTENTPISSFSTSIVVTPETPTTQAPPVLMSATGTQTSPVPTTVTFGSMDSSTSTLHTLTPSTALSKIMSTSQFPIPSTHSSTLQTTPSIPSLQTSLTSTSEFTTESFTRGSTSTNAILTSFSTIIWSSTPTIIMSSSPSSASITPVFATTIHSVPSSPYIFSTENVGSASITAFPSLSSSSTTSTSPTSSSLTTALTEITPFSYISLPSTTPCPGTITITIVPASPTDPCVEMDPSTEATSPPTTPLTVFPFTTEMVTCPSSISMQTTLATHMDTSSMTPESESSIIPNASSSTGTGTVPTNTVFTSTRLPTSETWLSNNSVIPTPLPGVSTIPLTMKPSSSLPTILRTSSKSTHPSPPTARTSETSVATTQTPTTLTTRRTTPITSWMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQTLCFKPDSIKVNNNSKTELTPEAICRRAAPTGYEEFYFPLVEATRLRCVTKCTSGVDNAIDCHQGQCVLETSGPACRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFHVALENVDTTMKVHIKRPEMTSSSV

SEQ ID NO: 38 - protein, 5703 aa, Homo Sapiens
MGAPSACRTLVLALAAMLVVPQAETQGPVEPSWGNAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGSTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPRQSAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVASGDMETFENIRAAGGKMCWAPKSIECRAENYPEVSIDQVGQVLTCSLETGLTCKNEDQTGRFNMCFNYNVRVLCCDDYSHCPSTLATSSTATPSSTPGTTWILTKPTTTATTTASTGSTATASSTQATAGTPHVSTTATTPTVTSSKATPFSSPGTATALPALRSTATTPTATSFTAIPSSSLGTTWTRLSQTTTPMATMSTATPSSTPETVHTSTVLTTTATTTGATGSVATPSSTPGTAHTTKVLTTTTTGFTATPSSSPGRARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVCTAWTSATSGILGTTHITEPSTGTSHTPAATTGTTQHSTPALSSPHPSSRTTESPPSPGTTTPGHTTATSRTTATATPSKTRTSTLLPSQPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTELTTTATTTESTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTRPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSQATTPTATSSKATSSSSPRTATTLPVLTSTATKSTATSFTPIPSSTLGTTGTSQNRPPHPMATMSTIHPSSTPETTHTSTVLTTKATTTRATSSMSTPSSTPGTTWILTELTTAATTTAALPHGTPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTATTTRTGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVPTAWTSATSGILGTTHITEPSTGTSHTPAATTGTTQPSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTQGPPAGTPHVSTTATTPTVTSSKATPFSSPGTATALPALRSTATTPTATSFTAIPSSSLGTTWTRLSQTTTPMATMSTATPSSTPETVHTSTVLTTTATTTGATGSVATPSSTPGTAHTTKVPTTTTTGFTVTPSSSPGTARTPPVWISTTTTPTTSGSTVTPSSIPGTTHTPTVLTTTTQPVATGSMATPSSSTQTSGTPPSLITTATTITATGSTTNPSSTPGTTPIPPELTTTATTPAATSSTVTPSSALGTTHTPPVPNTTATTHGRSLSPSSPHTVRTAWTSATSGTLGTTHITEPSTGTSHTPAATTGTTTTSTPALSSPHPSSRTTESPPSPGTTTPGHTTATSRTTATATPSKTRTSTLLPSQPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTRATSSTSTPSSTPGTTWILTELTTAATTTAGTGPTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTTTATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPIPPVLTSMATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATTSSTLGTAHTPKVVTAMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVTVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 39 - protein, 2699 aa, Homo Sapiens [sequence omitted]

SEQ ID NO: 40 - protein, 5478 aa, Homo Sapiens
MLVIWILTLALRLCASVTTVTPEGSAVHKAISQQGTLWTGEVLEKQTVEQGKSTLRRQKNHFHRSAGELRCRNALKDEGASAGWSVMFAGESVVVLVHLWMTGARVKNLGLVEFASPGDDGDGRAEGFSLGLPLSEQARAAGAREKERQETVINHSTFSGFSQITGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 41 - protein, 512 aa, Homo Sapiens
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 42 - protein, 261 aa, Homo Sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 43 - protein, 334 aa, Homo Sapiens
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 44 - protein, 22152 aa, Homo Sapiens
  misc_feature (13877)..(13878): Xaa can be any naturally occurring amino acid
  misc_feature (13880)..(13880): Xaa can be any naturally occurring amino acid
  misc_feature (13887)..(13887): Xaa can be any naturally occurring amino acid
  misc_feature (13890)..(13891): Xaa can be any naturally occurring amino acid
  misc_feature (13893)..(13893): Xaa can be any naturally occurring amino acid
  misc_feature (13903)..(13903): Xaa can be any naturally occurring amino acid
  misc_feature (13913)..(13914): Xaa can be any naturally occurring amino acid
  misc_feature (13916)..(13916): Xaa can be any naturally occurring amino acid
  misc_feature (13928)..(13929): Xaa can be any naturally occurring amino acid
  misc_feature (13938)..(13938): Xaa can be any naturally occurring amino acid
  misc_feature (13940)..(13941): Xaa can be any naturally occurring amino acid
  misc_feature (14569)..(14571): Xaa can be any naturally occurring amino acid
  misc_feature (14575)..(14575): Xaa can be any naturally occurring amino acid
  misc_feature (14579)..(14579): Xaa can be any naturally occurring amino acid
  misc_feature (14581)..(14581): Xaa can be any naturally occurring amino acid
  misc_feature (14587)..(14591): Xaa can be any naturally occurring amino acid
  misc_feature (14593)..(14594): Xaa can be any naturally occurring amino acid
  misc_feature (14725)..(14727): Xaa can be any naturally occurring amino acid
  misc_feature (14731)..(14731): Xaa can be any naturally occurring amino acid
  misc_feature (14735)..(14735): Xaa can be any naturally occurring amino acid
  misc_feature (14737)..(14737): Xaa can be any naturally occurring amino acid
  misc_feature (14743)..(14747): Xaa can be any naturally occurring amino acid
  misc_feature (14749)..(14750): Xaa can be any naturally occurring amino acid
  misc_feature (15661)..(15663): Xaa can be any naturally occurring amino acid
  misc_feature (15667)..(15667): Xaa can be any naturally occurring amino acid
  misc_feature (15671)..(15671): Xaa can be any naturally occurring amino acid
  misc_feature (15673)..(15673): Xaa can be any naturally occurring amino acid
  misc_feature (15679)..(15683): Xaa can be any naturally occurring amino acid
  misc_feature (15685)..(15686): Xaa can be any naturally occurring amino acid
  misc_feature (15972)..(15974): Xaa can be any naturally occurring amino acid
  misc_feature (15978)..(15978): Xaa can be any naturally occurring amino acid
  misc_feature (15982)..(15982): Xaa can be any naturally occurring amino acid
  misc_feature (15984)..(15984): Xaa can be any naturally occurring amino acid
  misc_feature (15990)..(15994): Xaa can be any naturally occurring amino acid
  misc_feature (15996)..(15997): Xaa can be any naturally occurring amino acid
  misc_feature (16008)..(16008): Xaa can be any naturally occurring amino acid
  misc_feature (16015)..(16015): Xaa can be any naturally occurring amino acid
  misc_feature (16017)..(16017): Xaa can be any naturally occurring amino acid
  misc_feature (16021)..(16021): Xaa can be any naturally occurring amino acid
  misc_feature (16025)..(16025): Xaa can be any naturally occurring amino acid
  misc_feature (16034)..(16034): Xaa can be any naturally occurring amino acid
  misc_feature (16037)..(16037): Xaa can be any naturally occurring amino acid
  misc_feature (16040)..(16040): Xaa can be any naturally occurring amino acid
  misc_feature (16046)..(16046): Xaa can be any naturally occurring amino acid
  misc_feature (16051)..(16051): Xaa can be any naturally occurring amino acid
  misc_feature (16053)..(16055): Xaa can be any naturally occurring amino acid
  misc_feature (16058)..(16058): Xaa can be any naturally occurring amino acid
  misc_feature (16062)..(16063): Xaa can be any naturally occurring amino acid
  misc_feature (16065)..(16065): Xaa can be any naturally occurring amino acid
  misc_feature (16072)..(16072): Xaa can be any naturally occurring amino acid
  misc_feature (16075)..(16076): Xaa can be any naturally occurring amino acid
  misc_feature (16078)..(16078): Xaa can be any naturally occurring amino acid
  misc_feature (16088)..(16088): Xaa can be any naturally occurring amino acid
  misc_feature (16268)..(16269): Xaa can be any naturally occurring amino acid
  misc_feature (16278)..(16278): Xaa can be any naturally occurring amino acid
  misc_feature (16280)..(16281): Xaa can be any naturally occurring amino acid
  misc_feature (16373)..(16374): Xaa can be any naturally occurring amino acid
  misc_feature (16376)..(16376): Xaa can be any naturally occurring amino acid
  misc_feature (16383)..(16383): Xaa can be any naturally occurring amino acid
  misc_feature (16386)..(16387): Xaa can be any naturally occurring amino acid
  misc_feature (16389)..(16389): Xaa can be any naturally occurring amino acid
  misc_feature (16399)..(16399): Xaa can be any naturally occurring amino acid
  misc_feature (16409)..(16410): Xaa can be any naturally occurring amino acid
  misc_feature (16412)..(16412): Xaa can be any naturally occurring amino acid
  misc_feature (16424)..(16425): Xaa can be any naturally occurring amino acid
  misc_feature (16434)..(16434): Xaa can be any naturally occurring amino acid
  misc_feature (16436)..(16437): Xaa can be any naturally occurring amino acid
  misc_feature (16439)..(16441): Xaa can be any naturally occurring amino acid
  misc_feature (16445)..(16445): Xaa can be any naturally occurring amino acid
  misc_feature (16449)..(16449): Xaa can be any naturally occurring amino acid
  misc_feature (16451)..(16451): Xaa can be any naturally occurring amino acid
  misc_feature (16457)..(16461): Xaa can be any naturally occurring amino acid
  misc_feature (16463)..(16464): Xaa can be any naturally occurring amino acid
  misc_feature (16841)..(16842): Xaa can be any naturally occurring amino acid
  misc_feature (16844)..(16844): Xaa can be any naturally occurring amino acid
  misc_feature (16851)..(16851): Xaa can be any naturally occurring amino acid
  misc_feature (16854)..(16855): Xaa can be any naturally occurring amino acid
  misc_feature (16857)..(16857): Xaa can be any naturally occurring amino acid
  misc_feature (16867)..(16867): Xaa can be any naturally occurring amino acid
  misc_feature (16877)..(16878): Xaa can be any naturally occurring amino acid
  misc_feature (16880)..(16880): Xaa can be any naturally occurring amino acid
  misc_feature (16892)..(16893): Xaa can be any naturally occurring amino acid
  misc_feature (16902)..(16902): Xaa can be any naturally occurring amino acid
  misc_feature (16904)..(16905): Xaa can be any naturally occurring amino acid
  misc_feature (16907)..(16909): Xaa can be any naturally occurring amino acid
  misc_feature (16913)..(16913): Xaa can be any naturally occurring amino acid
  misc_feature (16917)..(16917): Xaa can be any naturally occurring amino acid
  misc_feature (16919)..(16919): Xaa can be any naturally occurring amino acid
  misc_feature (16925)..(16929): Xaa can be any naturally occurring amino acid
  misc_feature (16931)..(16932): Xaa can be any naturally occurring amino acid
  misc_feature (17465)..(17466): Xaa can be any naturally occurring amino acid
  misc_feature (17468)..(17468): Xaa can be any naturally occurring amino acid
  misc_feature (17475)..(17475): Xaa can be any naturally occurring amino acid
  misc_feature (17478)..(17479): Xaa can be any naturally occurring amino acid
  misc_feature (17481)..(17481): Xaa can be any naturally occurring amino acid
  misc_feature (17491)..(17491): Xaa can be any naturally occurring amino acid
  misc_feature (17501)..(17502): Xaa can be any naturally occurring amino acid
  misc_feature (17504)..(17504): Xaa can be any naturally occurring amino acid
  misc_feature (17516)..(17517): Xaa can be any naturally occurring amino acid
  misc_feature (17526)..(17526): Xaa can be any naturally occurring amino acid
  misc_feature (17528)..(17529): Xaa can be any naturally occurring amino acid
  misc_feature (17531)..(17533): Xaa can be any naturally occurring amino acid
  misc_feature (17537)..(17537): Xaa can be any naturally occurring amino acid
  misc_feature (17541)..(17541): Xaa can be any naturally occurring amino acid
  misc_feature (17543)..(17543): Xaa can be any naturally occurring amino acid
  misc_feature (17549)..(17553): Xaa can be any naturally occurring amino acid
  misc_feature (17555)..(17556): Xaa can be any naturally occurring amino acid
  misc_feature (17567)..(17567): Xaa can be any naturally occurring amino acid
  misc_feature (17574)..(17574): Xaa can be any naturally occurring amino acid
  misc_feature (17576)..(17576): Xaa can be any naturally occurring amino acid
  misc_feature (17580)..(17580): Xaa can be any naturally occurring amino acid
  misc_feature (17584)..(17584): Xaa can be any naturally occurring amino acid
  misc_feature (17593)..(17593): Xaa can be any naturally occurring amino acid
  misc_feature (17596)..(17596): Xaa can be any naturally occurring amino acid
  misc_feature (17599)..(17599): Xaa can be any naturally occurring amino acid
  misc_feature (17605)..(17605): Xaa can be any naturally occurring amino acid
  misc_feature (17610)..(17610): Xaa can be any naturally occurring amino acid
  misc_feature (17612)..(17614): Xaa can be any naturally occurring amino acid
  misc_feature (17617)..(17617): Xaa can be any naturally occurring amino acid
  misc_feature (17621)..(17622): Xaa can be any naturally occurring amino acid
  misc_feature (17624)..(17624): Xaa can be any naturally occurring amino acid
  misc_feature (17631)..(17631): Xaa can be any naturally occurring amino acid
  misc_feature (17777)..(17778): Xaa can be any naturally occurring amino acid
  misc_feature (17780)..(17780): Xaa can be any naturally occurring amino acid
  misc_feature (17787)..(17787): Xaa can be any naturally occurring amino acid
  misc_feature (17790)..(17791): Xaa can be any naturally occurring amino acid
  misc_feature (17793)..(17793): Xaa can be any naturally occurring amino acid
  misc_feature (17803)..(17803): Xaa can be any naturally occurring amino acid
  misc_feature (17813)..(17814): Xaa can be any naturally occurring amino acid
  misc_feature (17816)..(17816): Xaa can be any naturally occurring amino acid
  misc_feature (17828)..(17829): Xaa can be any naturally occurring amino acid
  misc_feature (17838)..(17838): Xaa can be any naturally occurring amino acid
  misc_feature (17840)..(17841): Xaa can be any naturally occurring amino acid
  misc_feature (17843)..(17845): Xaa can be any naturally occurring amino acid
  misc_feature (17849)..(17849): Xaa can be any naturally occurring amino acid
  misc_feature (17853)..(17853): Xaa can be any naturally occurring amino acid
  misc_feature (17855)..(17855): Xaa can be any naturally occurring amino acid
  misc_feature (17861)..(17865): Xaa can be any naturally occurring amino acid
  misc_feature (17867)..(17868): Xaa can be any naturally occurring amino acid
  misc_feature (17879)..(17879): Xaa can be any naturally occurring amino acid
  misc_feature (17886)..(17886): Xaa can be any naturally occurring amino acid
  misc_feature (17888)..(17888): Xaa can be any naturally occurring amino acid
  misc_feature (17892)..(17892): Xaa can be any naturally occurring amino acid
  misc_feature (17896)..(17896): Xaa can be any naturally occurring amino acid
  misc_feature (17905)..(17905): Xaa can be any naturally occurring amino acid
  misc_feature (17908)..(17908): Xaa can be any naturally occurring amino acid
  misc_feature (17911)..(17911): Xaa can be any naturally occurring amino acid
  misc_feature (17917)..(17917): Xaa can be any naturally occurring amino acid
  misc_feature (17922)..(17922): Xaa can be any naturally occurring amino acid
  misc_feature (17924)..(17926): Xaa can be any naturally occurring amino acid
  misc_feature (17929)..(17929): Xaa can be any naturally occurring amino acid
  misc_feature (17933)..(17934): Xaa can be any naturally occurring amino acid
  misc_feature (17936)..(17936): Xaa can be any naturally occurring amino acid
  misc_feature (17943)..(17943): Xaa can be any naturally occurring amino acid
  misc_feature (17946)..(17947): Xaa can be any naturally occurring amino acid
  misc_feature (17949)..(17949): Xaa can be any naturally occurring amino acid
  misc_feature (17959)..(17959): Xaa can be any naturally occurring amino acid
  misc_feature (18089)..(18090): Xaa can be any naturally occurring amino acid
  misc_feature (18092)..(18092): Xaa can be any naturally occurring amino acid
  misc_feature (18099)..(18099): Xaa can be any naturally occurring amino acid
  misc_feature (18102)..(18103): Xaa can be any naturally occurring amino acid
  misc_feature (18105)..(18105): Xaa can be any naturally occurring amino acid
  misc_feature (18115)..(18115): Xaa can be any naturally occurring amino acid
  misc_feature (18125)..(18126): Xaa can be any naturally occurring amino acid
  misc_feature (18128)..(18128): Xaa can be any naturally occurring amino acid
  misc_feature (18140)..(18141): Xaa can be any naturally occurring amino acid
  misc_feature (18150)..(18150): Xaa can be any naturally occurring amino acid
  misc_feature (18152)..(18153): Xaa can be any naturally occurring amino acid
  misc_feature (18155)..(18157): Xaa can be any naturally occurring amino acid
  misc_feature (18161)..(18161): Xaa can be any naturally occurring amino acid
  misc_feature (18165)..(18165): Xaa can be any naturally occurring amino acid
  misc_feature (18167)..(18167): Xaa can be any naturally occurring amino acid
  misc_feature (18173)..(18177): Xaa can be any naturally occurring amino acid
  misc_feature (18179)..(18180): Xaa can be any naturally occurring amino acid
  misc_feature (18191)..(18191): Xaa can be any naturally occurring amino acid
  misc_feature (18198)..(18198): Xaa can be any naturally occurring amino acid
  misc_feature (18200)..(18200): Xaa can be any naturally occurring amino acid
  misc_feature (18204)..(18204): Xaa can be any naturally occurring amino acid
  misc_feature (18208)..(18208): Xaa can be any naturally occurring amino acid
  misc_feature (18217)..(18217): Xaa can be any naturally occurring amino acid
  misc_feature (18220)..(18220): Xaa can be any naturally occurring amino acid
  misc_feature (18223)..(18223): Xaa can be any naturally occurring amino acid
  misc_feature (18229)..(18229): Xaa can be any naturally occurring amino acid
  misc_feature (18234)..(18234): Xaa can be any naturally occurring amino acid
  misc_feature (18236)..(18238): Xaa can be any naturally occurring amino acid
  misc_feature (18241)..(18241): Xaa can be any naturally occurring amino acid
  misc_feature (18245)..(18246): Xaa can be any naturally occurring amino acid
  misc_feature (18248)..(18248): Xaa can be any naturally occurring amino acid
  misc_feature (18255)..(18255): Xaa can be any naturally occurring amino acid
  misc_feature (18258)..(18259): Xaa can be any naturally occurring amino acid
  misc_feature (18261)..(18261): Xaa can be any naturally occurring amino acid
  misc_feature (18271)..(18271): Xaa can be any naturally occurring amino acid
  misc_feature (18401)..(18402): Xaa can be any naturally occurring amino acid
  misc_feature (18404)..(18404): Xaa can be any naturally occurring amino acid
  misc_feature (18411)..(18411): Xaa can be any naturally occurring amino acid
  misc_feature (18414)..(18415): Xaa can be any naturally occurring amino acid
  misc_feature (18417)..(18417): Xaa can be any naturally occurring amino acid
  misc_feature (18427)..(18427): Xaa can be any naturally occurring amino acid
  misc_feature (18437)..(18438): Xaa can be any naturally occurring amino acid
  misc_feature (18440)..(18440): Xaa can be any naturally occurring amino acid
  misc_feature (18452)..(18453): Xaa can be any naturally occurring amino acid
  misc_feature (18462)..(18462): Xaa can be any naturally occurring amino acid
  misc_feature (18464)..(18465): Xaa can be any naturally occurring amino acid
  misc_feature (18467)..(18469): Xaa can be any naturally occurring amino acid
  misc_feature (18473)..(18473): Xaa can be any naturally occurring amino acid
  misc_feature (18477)..(18477): Xaa can be any naturally occurring amino acid
  misc_feature (18479)..(18479): Xaa can be any naturally occurring amino acid
  misc_feature (18485)..(18489): Xaa can be any naturally occurring amino acid
  misc_feature (18491)..(18492): Xaa can be any naturally occurring amino acid
  misc_feature (18503)..(18503): Xaa can be any naturally occurring amino acid
  misc_feature (18510)..(18510): Xaa can be any naturally occurring amino acid
  misc_feature (18512)..(18512): Xaa can be any naturally occurring amino acid
  misc_feature (18516)..(18516): Xaa can be any naturally occurring amino acid
  misc_feature (18520)..(18520): Xaa can be any naturally occurring amino acid
  misc_feature (18529)..(18529): Xaa can be any naturally occurring amino acid
  misc_feature (18532)..(18532): Xaa can be any naturally occurring amino acid
  misc_feature (18535)..(18535): Xaa can be any naturally occurring amino acid
  misc_feature (18541)..(18541): Xaa can be any naturally occurring amino acid
  misc_feature (18546)..(18546): Xaa can be any naturally occurring amino acid
  misc_feature (18548)..(18550): Xaa can be any naturally occurring amino acid
  misc_feature (18553)..(18553): Xaa can be any naturally occurring amino acid
  misc_feature (18557)..(18558): Xaa can be any naturally occurring amino acid
  misc_feature (18560)..(18560): Xaa can be any naturally occurring amino acid
  misc_feature (18567)..(18567): Xaa can be any naturally occurring amino acid
  misc_feature (18570)..(18571): Xaa can be any naturally occurring amino acid
  misc_feature (18573)..(18573): Xaa can be any naturally occurring amino acid
  misc_feature (18583)..(18583): Xaa can be any naturally occurring amino acid
  misc_feature (18713)..(18714): Xaa can be any naturally occurring amino acid
  misc_feature (18716)..(18716): Xaa can be any naturally occurring amino acid
  misc_feature (18723)..(18723): Xaa can be any naturally occurring amino acid
  misc_feature (18726)..(18727): Xaa can be any naturally occurring amino acid
  misc_feature (18729)..(18729): Xaa can be any naturally occurring amino acid
  misc_feature (18739)..(18739): Xaa can be any naturally occurring amino acid
  misc_feature (18749)..(18750): Xaa can be any naturally occurring amino acid
  misc_feature (18752)..(18752): Xaa can be any naturally occurring amino acid
  misc_feature (18764)..(18765): Xaa can be any naturally occurring amino acid
  misc_feature (18774)..(18774): Xaa can be any naturally occurring amino acid
  misc_feature (18776)..(18777): Xaa can be any naturally occurring amino acid
  misc_feature (18779)..(18781): Xaa can be any naturally occurring amino acid
  misc_feature (18785)..(18785): Xaa can be any naturally occurring amino acid
  misc_feature (18789)..(18789): Xaa can be any naturally occurring amino acid
  misc_feature (18791)..(18791): Xaa can be any naturally occurring amino acid
  misc_feature (18797)..(18801): Xaa can be any naturally occurring amino acid
  misc_feature (18803)..(18804): Xaa can be any naturally occurring amino acid
  misc_feature (18815)..(18815): Xaa can be any naturally occurring amino acid
  misc_feature (18822)..(18822): Xaa can be any naturally occurring amino acid
  misc_feature (18824)..(18824): Xaa can be any naturally occurring amino acid
  misc_feature (18828)..(18828): Xaa can be any naturally occurring amino acid
  misc_feature (18832)..(18832): Xaa can be any naturally occurring amino acid
  misc_feature (18841)..(18841): Xaa can be any naturally occurring amino acid
  misc_feature (18844)..(18844): Xaa can be any naturally occurring amino acid
  misc_feature (18847)..(18847): Xaa can be any naturally occurring amino acid
  misc_feature (18853)..(18853): Xaa can be any naturally occurring amino acid
  misc_feature (18858)..(18858): Xaa can be any naturally occurring amino acid
  misc_feature (18860)..(18862): Xaa can be any naturally occurring amino acid
  misc_feature (18865)..(18865): Xaa can be any naturally occurring amino acid
  misc_feature (18869)..(18870): Xaa can be any naturally occurring amino acid
  misc_feature (18872)..(18872): Xaa can be any naturally occurring amino acid
  misc_feature (18879)..(18879): Xaa can be any naturally occurring amino acid
  misc_feature (18882)..(18883): Xaa can be any naturally occurring amino acid
  misc_feature (18885)..(18885): Xaa can be any naturally occurring amino acid
  misc_feature (18895)..(18895): Xaa can be any naturally occurring amino acid
  misc_feature (19091)..(19093): Xaa can be any naturally occurring amino acid
  misc_feature (19097)..(19097): Xaa can be any naturally occurring amino acid
  misc_feature (19101)..(19101): Xaa can be any naturally occurring amino acid
  misc_feature (19103)..(19103): Xaa can be any naturally occurring amino acid
  misc_feature (19109)..(19113): Xaa can be any naturally occurring amino acid
  misc_feature (19115)..(19116): Xaa can be any naturally occurring amino acid
  misc_feature (19127)..(19127): Xaa can be any naturally occurring amino acid
  misc_feature (19134)..(19134): Xaa can be any naturally occurring amino acid
  misc_feature (19136)..(19136): Xaa can be any naturally occurring amino acid
  misc_feature (19140)..(19140): Xaa can be any naturally occurring amino acid
  misc_feature (19144)..(19144): Xaa can be any naturally occurring amino acid
  misc_feature (19153)..(19153): Xaa can be any naturally occurring amino acid
  misc_feature (19156)..(19156): Xaa can be any naturally occurring amino acid
  misc_feature (19159)..(19159): Xaa can be any naturally occurring amino acid
  misc_feature (19165)..(19165): Xaa can be any naturally occurring amino acid
  misc_feature (19170)..(19170): Xaa can be any naturally occurring amino acid
  misc_feature (19172)..(19174): Xaa can be any naturally occurring amino acid
  misc_feature (19177)..(19177): Xaa can be any naturally occurring amino acid
  misc_feature (19181)..(19182): Xaa can be any naturally occurring amino acid
  misc_feature (19184)..(19184): Xaa can be any naturally occurring amino acid
  misc_feature (19191)..(19191): Xaa can be any naturally occurring amino acid
  misc_feature (19194)..(19195): Xaa can be any naturally occurring amino acid
  misc_feature (19197)..(19197): Xaa can be any naturally occurring amino acid
  misc_feature (19207)..(19207): Xaa can be any naturally occurring amino acid
  misc_feature (19337)..(19338): Xaa can be any naturally occurring amino acid
  misc_feature (19340)..(19340): Xaa can be any naturally occurring amino acid
  misc_feature (19347)..(19347): Xaa can be any naturally occurring amino acid
  misc_feature (19350)..(19351): Xaa can be any naturally occurring amino acid
  misc_feature (19353)..(19353): Xaa can be any naturally occurring amino acid
  misc_feature (19363)..(19363): Xaa can be any naturally occurring amino acid
  misc_feature (19373)..(19374): Xaa can be any naturally occurring amino acid
  misc_feature (19376)..(19376): Xaa can be any naturally occurring amino acid
  misc_feature (19388)..(19389): Xaa can be any naturally occurring amino acid
  misc_feature (19398)..(19398): Xaa can be any naturally occurring amino acid
  misc_feature (19400)..(19401): Xaa can be any naturally occurring amino acid
  misc_feature (19403)..(19405): Xaa can be any naturally occurring amino acid
  misc_feature (19409)..(19409): Xaa can be any naturally occurring amino acid
  misc_feature (19413)..(19413): Xaa can be any naturally occurring amino acid
  misc_feature (19415)..(19415): Xaa can be any naturally occurring amino acid
  misc_feature (19421)..(19425): Xaa can be any naturally occurring amino acid
  misc_feature (19427)..(19428): Xaa can be any naturally occurring amino acid
  misc_feature (19439)..(19439): Xaa can be any naturally occurring amino acid
  misc_feature (19446)..(19446): Xaa can be any naturally occurring amino acid
  misc_feature (19448)..(19448): Xaa can be any naturally occurring amino acid
  misc_feature (19452)..(19452): Xaa can be any naturally occurring amino acid
  misc_feature (19456)..(19456): Xaa can be any naturally occurring amino acid
  misc_feature (19465)..(19465): Xaa can be any naturally occurring amino acid
  misc_feature (19468)..(19468): Xaa can be any naturally occurring amino acid
  misc_feature (19471)..(19471): Xaa can be any naturally occurring amino acid
  misc_feature (19477)..(19477): Xaa can be any naturally occurring amino acid
  misc_feature (19482)..(19482): Xaa can be any naturally occurring amino acid
  misc_feature (19484)..(19486): Xaa can be any naturally occurring amino acid
  misc_feature (19489)..(19489): Xaa can be any naturally occurring amino acid
  misc_feature (19493)..(19494): Xaa can be any naturally occurring amino acid
  misc_feature (19496)..(19496): Xaa can be any naturally occurring amino acid
  misc_feature (19503)..(19503): Xaa can be any naturally occurring amino acid
  misc_feature (19506)..(19507): Xaa can be any naturally occurring amino acid
  misc_feature (19509)..(19509): Xaa can be any naturally occurring amino acid
  misc_feature (19519)..(19519): Xaa can be any naturally occurring amino acid
  misc_feature (19649)..(19650): Xaa can be any naturally occurring amino acid
  misc_feature (19652)..(19652): Xaa can be any naturally occurring amino acid
  misc_feature (19659)..(19659): Xaa can be any naturally occurring amino acid
  misc_feature (19662)..(19663): Xaa can be any naturally occurring amino acid
  misc_feature (19665)..(19665): Xaa can be any naturally occurring amino acid
  misc_feature (19675)..(19675): Xaa can be any naturally occurring amino acid
  misc_feature (19685)..(19686): Xaa can be any naturally occurring amino acid
  misc_feature (19688)..(19688): Xaa can be any naturally occurring amino acid
  misc_feature (19700)..(19701): Xaa can be any naturally occurring amino acid
  misc_feature (19710)..(19710): Xaa can be any naturally occurring amino acid
  misc_feature (19712)..(19713): Xaa can be any naturally occurring amino acid
  misc_feature (19715)..(19717): Xaa can be any naturally occurring amino acid
  misc_feature (19721)..(19721): Xaa can be any naturally occurring amino acid
  misc_feature (19725)..(19725): Xaa can be any naturally occurring amino acid
  misc_feature (19727)..(19727): Xaa can be any naturally occurring amino acid
  misc_feature (19733)..(19737): Xaa can be any naturally occurring amino acid
  misc_feature (19739)..(19740): Xaa can be any naturally occurring amino acid
  misc_feature (19751)..(19751): Xaa can be any naturally occurring amino acid
  misc_feature (19758)..(19758): Xaa can be any naturally occurring amino acid
  misc_feature (19760)..(19760): Xaa can be any naturally occurring amino acid
  misc_feature (19764)..(19764): Xaa can be any naturally occurring amino acid
  misc_feature (19768)..(19768): Xaa can be any naturally occurring amino acid
  misc_feature (19777)..(19777): Xaa can be any naturally occurring amino acid
  misc_feature (19780)..(19780): Xaa can be any naturally occurring amino acid
  misc_feature (19783)..(19783): Xaa can be any naturally occurring amino acid
  misc_feature (19789)..(19789): Xaa can be any naturally occurring amino acid
  misc_feature (19794)..(19794): Xaa can be any naturally occurring amino acid
  misc_feature (19796)..(19798): Xaa can be any naturally occurring amino acid
  misc_feature (19801)..(19801): Xaa can be any naturally occurring amino acid
  misc_feature (19805)..(19806): Xaa can be any naturally occurring amino acid
  misc_feature (19808)..(19808): Xaa can be any naturally occurring amino acid
  misc_feature (19815)..(19815): Xaa can be any naturally occurring amino acid
  misc_feature (19818)..(19819): Xaa can be any naturally occurring amino acid
  misc_feature (19821)..(19821): Xaa can be any naturally occurring amino acid
  misc_feature (19831)..(19831): Xaa can be any naturally occurring amino acid
  misc_feature (19960)..(19961): Xaa can be any naturally occurring amino acid
  misc_feature (19963)..(19963): Xaa can be any naturally occurring amino acid
  misc_feature (19970)..(19970): Xaa can be any naturally occurring amino acid
  misc_feature (19973)..(19974): Xaa can be any naturally occurring amino acid
  misc_feature (19976)..(19976): Xaa can be any naturally occurring amino acid
  misc_feature (19986)..(19986): Xaa can be any naturally occurring amino acid
  misc_feature (19996)..(19997): Xaa can be any naturally occurring amino acid
  misc_feature (19999)..(19999): Xaa can be any naturally occurring amino acid
  misc_feature (20011)..(20012): Xaa can be any naturally occurring amino acid
  misc_feature (20021)..(20021): Xaa can be any naturally occurring amino acid
  misc_feature (20023)..(20024): Xaa can be any naturally occurring amino acid
  misc_feature (20026)..(20028): Xaa can be any naturally occurring amino acid
  misc_feature (20032)..(20032): Xaa can be any naturally occurring amino acid
  misc_feature (20036)..(20036): Xaa can be any naturally occurring amino acid
  misc_feature (20038)..(20038): Xaa can be any naturally occurring amino acid
  misc_feature (20044)..(20048): Xaa can be any naturally occurring amino acid
  misc_feature (20050)..(20051): Xaa can be any naturally occurring amino acid
  misc_feature (20062)..(20062): Xaa can be any naturally occurring amino acid
  misc_feature (20069)..(20069): Xaa can be any naturally occurring amino acid
  misc_feature (20071)..(20071): Xaa can be any naturally occurring amino acid
  misc_feature (20075)..(20075): Xaa can be any naturally occurring amino acid
  misc_feature (20079)..(20079): Xaa can be any naturally occurring amino acid
  misc_feature (20088)..(20088): Xaa can be any naturally occurring amino acid
  misc_feature (20091)..(20091): Xaa can be any naturally occurring amino acid
  misc_feature (20094)..(20094): Xaa can be any naturally occurring amino acid
  misc_feature (20100)..(20100): Xaa can be any naturally occurring amino acid
  misc_feature (20105)..(20105): Xaa can be any naturally occurring amino acid
  misc_feature (20107)..(20109): Xaa can be any naturally occurring amino acid
  misc_feature (20112)..(20112): Xaa can be any naturally occurring amino acid
  misc_feature (20116)..(20117): Xaa can be any naturally occurring amino acid
  misc_feature (20119)..(20119): Xaa can be any naturally occurring amino acid
  misc_feature (20126)..(20126): Xaa can be any naturally occurring amino acid
  misc_feature (20129)..(20130): Xaa can be any naturally occurring amino acid
  misc_feature (20132)..(20132): Xaa can be any naturally occurring amino acid
  misc_feature (20142)..(20142): Xaa can be any naturally occurring amino acid
  misc_feature (20272)..(20273): Xaa can be any naturally occurring amino acid
  misc_feature (20275)..(20275): Xaa can be any naturally occurring amino acid
  misc_feature (20282)..(20282): Xaa can be any naturally occurring amino acid
  misc_feature (20285)..(20286): Xaa can be any naturally occurring amino acid
  misc_feature (20288)..(20288): Xaa can be any naturally occurring amino acid
  misc_feature (20298)..(20298): Xaa can be any naturally occurring amino acid
  misc_feature (20308)..(20309): Xaa can be any naturally occurring amino acid
  misc_feature (20311)..(20311): Xaa can be any naturally occurring amino acid
  misc_feature (20323)..(20324): Xaa can be any naturally occurring amino acid
  misc_feature (20333)..(20333): Xaa can be any naturally occurring amino acid
  misc_feature (20335)..(20336): Xaa can be any naturally occurring amino acid
  misc_feature (20806)..(20808): Xaa can be any naturally occurring amino acid
  misc_feature (20812)..(20812): Xaa can be any naturally occurring amino acid
  misc_feature (20816)..(20816): Xaa can be any naturally occurring amino acid
  misc_feature (20818)..(20818): Xaa can be any naturally occurring amino acid
  misc_feature (20824)..(20828): Xaa can be any naturally occurring amino acid
  misc_feature (20830)..(20831): Xaa can be any naturally occurring amino acid
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWASVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPSTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEVSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPETVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSVAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHVILTTDEDTTAIEAMHPSTSTAATNVETTCSGHGSQSSVLTDSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSFGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSPLTPGQVKTTEVLDASAEPETSSPPSLSSTSVEILATSEVTTDTEKIHPFPNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLATSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSALPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISSEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLATSKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMSSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPKTTPKFSHSKSDTTLPVAITSPGPEASSAVSTTTISPDMSDLVTSLVPSSGTDTSTTFPTLSETPYEPETTVTWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTGTSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNTTERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLXXEXLYWELSXLTXXIXELGPYTLDRXSLYVNGFTHXXSXPTTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTXNXTITNLXXXXXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSGLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTTLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTXNXTITNLXXXXXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGATTGMDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLXXEXLYWELSXLTXXIXELGPYTLDRXSLYVNGFTHXXSXPTTSTPGTSTVXXGTSGTPSSXPXXTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTXNXTITNLXXXXXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 45 - protein, 4493 aa, Homo Sapiens
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 46 - protein, 4858 aa, Homo Sapiens
  misc_feature (1)..(10): Xaa can be any naturally occurring amino acid
  misc_feature (4148)..(4157): Xaa can be any naturally occurring amino acid
XXXXXXXXXXSGSTGVSAGSITASPGASATSSESSKSGSTEGSVEATTSAGSGNTAGTSGTGDTGPGNTAGATGSSTGQTDTSGPSAKVTGNYGQSSEIPGTIKSSSDVSGTMGQSDTTSGPSVAVTRTSEQSSGVTVASEPSVGVSGTTGPLAEISGTTRPLVSGLRTTGSSAEGSGTTGPSSRESVTTRPLAEGSGTSGQSVTGSRATGLSATELGTTVSFTGGLGTSRSSARETRTTGPSADGSGTTGPSVVRSGTTRLSVGVTRATESSPGVTGTTTPSAEESRTTGPSVLVTGTTGQSGQGSGTTGKSFIESGPSVVGSGTTGPTSAGLGTTAPSTRRSSTTKPSVGRTGTTGQSGAESGTTEPSARVAGVTGTSAEVSGRIEPSATESSTSRPLGETTGTTIPSMEGSEATGPSVIGSETTRLSVIGSGTTGTSSGGSGATRSSGGGMGTTGQSTARSETTGPLFGLTGTFGQSATVTGTSSNSAGVTTPEKSPGVAMTTGLLVEGSATTQPRILESETTESSAGVIVTSGQSARVTGATGPSAGETGTTEPSTEGSVAAVLFVIGSETTRPLDIGSGTTGTLSGGSSTTRSSDGTTGTTRKSTARSETTGLSGLTGTSGQLAGVTGTSSKSAGVTVTSEKSAGVAVITGSFVERPVTTGPPLLESETTRPSGGVTVTSGQSARVTETVGASAGVTGTTGPSTEGSGATGPSVVGSGTTRPLAGESGTTESSAGVTGTRPSSSRESATTGPSDEGSGTTGLSAGVTVTSGQSVRKTGTTGAPAGVTETTRPSVVKSGTTGPSVIGTRTTGTSSGGSGATRSSGGETETTGQSAVKSGTTESFTRLTRTSGQSAGMTGTSAQSAGVALTSPFVEGLVTTGSSTVGLETTRPSAVGSGKTGPPVVKAQTTGPSAGVTVTSGQSARMTGASGPSVGVTGTTGPASKGLGTIRPSVVGLETTELSAEGSGTTGPPIVGETTVPSAGVTVTSGYSDRVTGATEPLAGVTGTIKPSVAGSVTTGPSVTGVETTAKTTSGGLSTTISSVGGTGTTGQSPERSGTTGPFTGLTGTSAQSAGVTMTSIQSAGVLVTTGLNVDGLGTTGKALIGSGTTGLSAEATGTIGPSTEGLEKTGPSITGSGTTRPLVTESWTAGTSSGGHSTTSPSVRGTETTGQSAAESVTTGPVTGYTETSGPSAGVTVTPRQSPTVTQTTGSSAAVSGTTVQSLTVSGTTRPSSGQTEITGSSVKESGTTESSAVRSGTTGPTAGVTGTNGPSSAGVTGITGSSPGVTGTTGSSPGVTGTTGSSARSGTSIPSVGKTGTTRTSVEESRTTRPSAGITGTNGLSAEVTGTTGPLAGVTGTTGPSAGVTRTTGLSAGETGTTGLSPGVTRTTRSSAGLTGKTGLSAGVTGKTGLSAEVTGTTRLSAGVTGTTGPSPGVTGTTGTPAGVTGTTELSAGVTGKTGLSSEVTETTGLSYGVKRTIGLSAGSTGTSGQSAGVAGTTTLSAEVTGTTRPSAGVTGTTGLSAEVTEITGISAVVTGTTGPSAGVTETTGSSAGVAGTTRLSAGVTGITGLSAGVTGTTGLSTEVTGTTGPSAGATGTTGLSVGVTGITGLSDVVTETTGSSARSGTGIPSVGETRTTSTSVEESRTTRPSAGIMGTNGLPAEVTGTTEPLAGGTGTTGILAGVTGTTGLSAGETGKIGSSAGVTGKTGSSARVTGKTGPSAEVTGKTGLSAGVTGTTGLSPGVTGTSGLSAEVTGTTGPSAEATGLPGVSAGVTGTTGSLAGGTGTIGLSAGVTGTTGSSAGVTGTTGLSAGVTGIAGLSAGVTGITGPSAGVTGTTTVSAGVTGTTGLSAEATEITGLSAGVTGTTGLSAGVTETIRLSAGVTGTIRSSAGVTGITGLSAGVTGTTGPSAGVTGSTGLLAGVTETTGQSAKVTGTTGQSVGVTGTTRSSGGVTGITGLSAGVTGTNGLSAVTGMTGLSAEVTGTTGLSVGVTGIAGLSAGVTGITGPSAGITGTTTISAGVTGTSGLSAEATGITGLSAGVTGKTGLSAGVTETIGLSAEATGTIGSSPGVTGTTGSSTGVTGITGLSAGVTGTTGLSTEVTGTTGPSAGVTRTTGLSAGVTGITGLSAIVTETTGSSARSGTSIPSVGETGTTRTSVEESRTTRPSAGITGTTGLSAGVTGTVGSSAVVTGTTGLSAGVTGTTGPSAEETGATGPSAEVTETTGPSAGVTGTGRLSAEVTGTTGPSAEVTGLPGESAEVTGTIGSPAGVTGTTQLSAVVTGITGLSAEVTGTTGLSAGVTGITGLSAEVTRTTGLSAGVTGTIGLSAGVTGTTRPSAGVTGTTGQSAEVTGTTEPSAGLTETTGSSTGVTGATGPLAGVTGTTGISTEVTGTTGPSARVTGTTVLSAGVTGITGLSAIVTETTGSSARSGTSTPSVGETGTTRTSVEESRATRPSAGITGTNGQSAEVTWITGPLAGVTGTTGISAGVTGTTGLSAGVTGTIGSSAVVTGINGLSAGVTGTTGPSAEETGATGPSAEVTGTTGPSAEETGATGPSAEVTGTTGPSGGVTGTNGLSAEVTGTTGPSAEVTGLPGVSAGVTGTIGSPAAVTGTIRPSAVVTGITGLSAEVTGTTGLSAWVTGIAGLSAGVTETIGSSAGVTGTNGLSAEATGTTGPSAGVTGTTGLSAGVTGTAGLSARVTESTGLSAGVTGTTGLSAGVTGTTGPSAGITGTNGLSAEVTGTTGPLAGVTGTIGLSAGVTGIAGLSAGVTESTGLSAGVTGTIRSSAVVTGINGLSAGVTGTTGPSAEETGATGPSAEVTGTTGPSGGVTGTSGISAEVTGTTGPSAEVTGLPGVSAGVTGTIGSPAAVTGTTRPSAVVTGISGLSAEVTGTTGLSAGVTETIGSSAGVTGTNGLSAEATETTGPSAGVTGTTGLSAGVTGTTGPSAGIAGTNGLSAGVTGTTGLSARVTESTGLSAGVTGTIGSSAVVTETTRLSSGVTGTIGPSAEETGATGLSAEVTGTTGSLAEVTGTTGLSAGVTGTIGSSAVVTGTTGLSAGITGTNGLSAEVTGTAGPLAGVTGTTGLSAGVTGTTGLSAGVTETTGQSAGVTESTGLSPGVTGTIGSSAVVTGIKGLSAGVTGTTGPSAEETGATGPSAEVTGTTGPSGGVTGTSVLSVEVTGTTGPSAEVTGLPGVSAGLTGTIGSPAAVRGTTWPSAVVTGISGLSGEVTGTTGLSAGVTGIGGLSAGVTGTIGSSAGVTGTNALSAEATGTTGPSAGVTGTTGLSAGVTGTTGLSAGVTGTIRSSAVVTETTGLSAGVTGTTGPSAGIAGTNGLSAEVTGTTGLSAGMTGTTGLSARVTESTGLSAGVTGTIGSSAVVTETTRLSAGVTGTIGPSAEETGATGLSAEVTRTTGSLAGVTGTTGPSAVVTGKTELSAEVTGTTELSAEVTEKTGPSAEVTGKTGLSAGVMETTGPSAEVTGTTGSSAGVTGTTGPSAGVTGTTGPSAEATGLPGVSAGVTGTIGSPAGVTGTARLSAVVTGISGLSAEVTGTTGLSTGVTGIAGHSAAVTGITRPSAGVTGTTTVSAGVTGTIGLSAEATGITLPSAGVTETTGLSAGVTETIGLSAGVTGTIGSSAGVTEITGLSAGVTGTTGPSAGVTGSTVLSAGVTATTGQSVGVTGTTGPSAGVTGTTGLSAGVTGIAGLSAGVTGITGPSAGVTGTTTVSAGVTGTTGLSAEATEITGLSAGVTGTTGLSAGVTGIAGLSAGVTETIGSSAGVTGTNGLSAEATGKTGPSAGVTGTTGLSAGVTGTTGLSAGVTETIGLSAGVTGTIGSSAGVKGTTGQSAEVTGATGQSVGVTGTTRSSGGVTGITGLSAGLRGTTVSSAKAGTSIPLTGKTGTTRTSVEESTTTGPSAGITGTNGLSAEMTGTNELSAGVTGTIGSSAGVTGTTGLSVEATVTTGLSAGVTGTTVPLAGVTWTPGPSAGVTGIAALSAGVTGKSGLSAGVTGKTGLSAGVTGTTGPSAEATGKTGLSAGVTGITGPFAEVTGTTGLSAGVIGTTGSSAEVTGITGLSAGVTGKTRSSAGVTGTTGLSAKSGTSIPSAGKTGTTKTSVEESRTTRPSAGITGTNGLPARVTGTXXXXXXXXXXGTSGVAPGTTVAPGSFSTAATTSPGASGVTGTGPTAETTTFLGGSSTTGAEIKSGATTGAPGSKTGTAKVLSGTTVASGSSNSEATTFSGITEAVTVPSKNGSMTTALGSQLSSSQTVIPGSSGTISHTTVAPGSSVTGTTTGASDDQVTGSKTGTTGVALSTTVAPGSSSTEATTSTGVHRTTVVGQKTGATTRGSAKQGTRSTIEATTSFRGTGTTGSGMNTGTTGVVSGNTISPSSFNTEATSGTSERPNPGSEIGTTGIVSGTTVAPGSSNTEATTSLGNGGTTEAGSKIVTTGITTGTTIVPGSFNTKATTSTDVGVATGVGMATGITNIISGRSQPTGSKTGYTVTGSGTTALPGGFRTGNTPGSTGVTSSQEGTTVVSSGITGIPETSISGPSKEASDKTTAPGPPTTVTASTGVKETSETGVQTGSTLVTAGVPTRPQVSQPETTVVATREVETENKTECLASLPPAPVCHGPLGEEKSPGDIWTANCHRGTCTDAKTIDCKPEECPSPPTCKTGEKLVKFQSNDTCCEIGYCEPRTCLFNNTDYEIGASFDDPSNPCVSYSCKDTGFAAVVQDCPKQTWCAEANRIYDSKKCCYTCKNNCRSSLVNVTVIYSGCKKRVQMAKCTGECEKTAKYNHDILLLEHSCLCCREENYELRDIVLDCPDGSTIPYQYKHITTCSCLDICQLYTTFMYS

SEQ ID NO: 47 - protein, 709 aa, Homo Sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 48 - protein, 566 aa, Homo Sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 49 - protein, 1333 aa, Homo Sapiens
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSAASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVHSANAEDRTSGVPSLGTHTLATVTGNGERTLRSVTLTNTSMSTTSGEAGSPAAAMHQETEGASLHVNVTDDMGLVSRSLAASSALGVAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 50 - protein, 678 aa, Homo Sapiens
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 51 - protein, 646 aa, Homo Sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 52 - protein, 15 aa, Homo Sapiens
QETFSDLWKLLPENN

SEQ ID NO: 53 - protein, 15 aa, Homo Sapiens
DLWKLLPENNVLSPL

SEQ ID NO: 54 - protein, 15 aa, Homo Sapiens
DDLMLSPDDIEQWFT

SEQ ID NO: 55 - protein, 15 aa, Homo Sapiens
SPDDIEQWFTEDPGP

SEQ ID NO: 56 - protein, 15 aa, Homo Sapiens
MPEAAPRVAPAPAAP

SEQ ID NO: 57 - protein, 15 aa, Homo Sapiens
SVTCTYSPALNKMFC

SEQ ID NO: 58 - protein, 15 aa, Homo Sapiens
YSPALNKMFCQLAKT

SEQ ID NO: 59 - protein, 15 aa, Homo Sapiens
NKMFCQLAKTCPVQL

SEQ ID NO: 60 - protein, 15 aa, Homo Sapiens
SQHMTEVVRRCPHHE

SEQ ID NO: 61 - protein, 15 aa, Homo Sapiens
PQHLIRVEGNLRVEY

SEQ ID NO: 62 - protein, 15 aa, Homo Sapiens
LRVEYLDDRNTFRHS

SEQ ID NO: 63 - protein, 15 aa, Homo Sapiens
LDDRNTFRHSVVVPY

SEQ ID NO: 64 - protein, 15 aa, Homo Sapiens
TFRHSVVVPYEPPEV

SEQ ID NO: 65 - protein, 15 aa, Homo Sapiens
VVVPYEPPEVGSDCT

SEQ ID NO: 66 - protein, 15 aa, Homo Sapiens
EPPEVGSDCTTIHYN

SEQ ID NO: 67 - protein, 15 aa, Homo Sapiens
KKGEPHHELPPGSTK

SEQ ID NO: 68 - protein, 15 aa, Homo Sapiens
HHELPPGSTKRALPN

SEQ ID NO: 69 - protein, 13 aa, Homo Sapiens
KKLMFKTEGPDSD

The invention claimed is:

1. A method for detecting colorectal cancer, said method comprising
   (i) contacting a sample from a sample host with one or more different mucin peptides selected from the group consisting of MUC1 and MUC4, wherein said one or more different mucin peptides individually consists of an amino acid sequence comprising at least 5 consecutive amino acid residues, and wherein at least one of said at least 5 amino acid residues is serine or threonine, and wherein at least one of said serine or threonine residues is O-glycosylated by a glycan independently selected from the group consisting of:
   Core-3 (GlcNAcβ1-3GalNAc-α-Ser/Thr),
   Tn(GalNAc-α-Ser/Thr),
   STn/sialyl-Tn (Neu5Acα2-6GalNAc-α-Ser/Thr),
   Core-2 (Galβ1-3(GlcNAcβ1-6)GalNAc-α-Ser/Thr)),
   Core-4 (GlcNAcβ1-3(GlcNAcβ1-6)GalNAc-α-Ser/Thr), and
   ST/sialyl-T(Neu5Acα2-3Galβ3GalNAc-Ser/Thr), and
   (ii) removing unbound sample, and
   (iii) qualitatively and/or quantitatively characterizing the bound material, wherein antibodies or antigen binding fragments of antibodies, bound to said one or more different O-glycosylated peptides, is indicative of colorectal cancer in the sample host; wherein said one or more different mucin peptides are individually selected from the group consisting of SEQ ID NOs: 3, 4, 5, 6, 7, 8, 9, 10, 11, 12, 13, 14, 15, 16, 17, 18, 19, 20, 21, 22, 23, 24, 25, 30 and 31; and wherein the one or more different O-glycosylated peptides are at least a first and at least a second O-glycosylated peptide wherein said first O-glycosylated peptide is selected from the group consisting of
   VTSAPDT(Core3)RPAPGSTAPPAHG (MUC1 Core3),
   VT(Core3)SAPDTRPAPGS(Core3)T(Core3)APPAHG (MUC1 9 Core3),
   VT(Core3)S(Core3)APDT(Core3)RPAPGS(Core3)T(Core3)APPAHG(MUC1 15 Core3),
   VT(STn)S(STn)APDT(STn)RPAPGS(STn)T(STn)APPAHG (MUC1 (15STn)),
   VT(STn)SAPDTRPAPGS(STn)T(STn)APPAHG (MUC1 9STn),
   VT(Tn)S(Tn)APDT(Tn)RP APGS(Tn)T(Tn)APPAHG (MUC1 15Tn),
   VT(Tn)SAPDTRPAPGS(Tn)T(Tn)APPAHG (MUC1 9Tn),
   VT(Tn)SAPDTRPAPGST(Tn)APPAHG (MUC1 6Tn),
   and wherein said second O-glycosylated peptide is selected from the group consisting of:
   PMT*DT*KT*VT*T*PGS*S*FT*A (SEQ ID NO:3),
   PGS*S*FT*AS*GHS*PS*EIVPQD (SEQ ID NO: 4),
   S*EIVPQDAPT*IS*AAT*T*FAPA (SEQ ID NO: 5),
   T*T*FAPAPT*GNGHT*T*QAPT*T*A (SEQ ID NO: 6),
   T*T*QAPT*T*ALQAAPS*S*HD (SEQ ID NO:7),
   APS*S*HDAT*LGPS*GGT*S*LS*KT* (SEQ ID NO:8),
   S*LS*KT*GALT*LANS*VVS*T*P (SEQ ID NO: 9),
   NS*VVS*T*PGGPEGQWT*S*AS*AS* (SEQ ID NO: 10),
   T*S*AS*AS*T*S*PRT*AAAMT*HT* (SEQ ID NO: 11),
   AAAMT*HT*HQAES*T*EAS*GQT* (SEQ ID NO: 12),
   EAS*GQT*QT*S*EPAS*S*GS*RT*T* (SEQ ID NO: 13),
   PAS*S*GS*RT*T*S*AGT*AT*PS*S*S* (SEQ ID NO: 14),
   T*AT*PS*S*S*GAS*GT*T*PS*GS*EGI (SEQ ID NO: 15), S*GS*EGIS*T*S*GET*T*RFS*S*N (SEQ ID NO: 16) and
GET*T*RFS*S*NPS*RDS*HT*T* (SEQ ID NO: 17),
PVT*S*PS*S*AS*T*GHT*T*PLPVT*DT*S*S*AS*T*GDT*T*P (SEQ ID NO: 18),
LPVT*S*LS*S*VS*T*GDT*T*PLPVT*S*PS*S*AS*T*GH (SEQ ID NO: 19),
LPVT*S*PS*S*AS*T*GHAS*PLLVT*DAS*S*AS*T*GQ (SEQ ID NO: 20),
PLPVT*S*PS*S*AS*T*GHAS*PLLVT*DAS*S*AS*T*GQ (SEQ ID NO: 21),
S*T*GDT*LPLPVT*DT*S*S*V (SEQ ID NO: 22),
PVT*YAS*S*AS*T*GDT*T*PLPVT*DT*S*S*VS*T*GHAT* (SEQ ID NO: 23),
PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30),
and wherein the asterisk (*) indicates a potential O-glycosylation site, wherein an optional glycan is located at the potential O-glycosylation site and is independently selected from the group consisting of Core-3 (GlcNAcβ1-3GalNAc-α-Ser/Thr), Tn (GalNAc-α-Ser(Thr), STn/sialyl-Tn (Neu5Acα2-6GalNAc-α-Ser/Thr), Core-2 (Galβ1-3(GlcNAcβ1-6)GalNAc-α-Ser/Thr)) Core-4 (GlcNAcβ1-3(GlcNAcβ1-6)GalNAcα-Ser/Tur), and ST/sialyl-T (Neu5Acα2-3Galβ3GalNAc-Ser/Thr).

2. The method of claim 1, wherein the one or more peptides are selected from the group consisting of:
a) MUC4 Tn selected from the group consisting of
PVT*S*PS*S*AS*T*GHT*T*PLPVT*DT*S*S*AS*T*GDT*T*P (SEQ ID NO: 18),
LPVT*S*LS*S*VS*T*GDT*T*PLPVT*S*PS*S*AS*T*GH (SEQ ID NO: 19),
LPVT*S*PS*S*AS*T*GHAS*PLLVT*DAS*S*AS*T*GQ (SEQ ID NO: 20),
PLPVT*S*PS*S*AS*T*GHAS*PLLVT*DAS*S*AS*T*GQ (SEQ ID NO: 21),
S*T*GDT*LPLPVT*DT*S*S*V (SEQ ID NO: 22) and
PVT*YAS*S*AS*T*GDT*T*PLPVT*DT*S*S*VS*T*GHAT* (SEQ ID NO: 23),
wherein the asterisk (*) indicates a potential O-glycosylation site, wherein an optional glycan is located at the potential O-glycosylation site and is Tn (GalNAc-α-Ser/Thr) and
b) a Tn glycosylated MUC4 peptide selected from the group consisting of
PMT*DT*KT*VT*T*PGS*S*FT*A (SEQ ID NO:3),
PGS*S*FT*AS*GHS*PS*EIVPQD (SEQ ID NO: 4),
S*EIVPQDAPT*IS*AAT*T*FAPA (SEQ ID NO: 5),
*T*T*FAPAPT*GNGHT*T*QAPT*T*A (SEQ ID NO: 6),
T*T*QAPT*T*ALQAAPS*S*HD (SEQ ID NO: 7),
APS*S*HDAT*LGPS*GGT*S*LS*KT* (SEQ ID NO:8),
S*LS*KT*GALT*LANS*VVS*T*P (SEQ ID NO: 9),
NS*VVS*T*PGGPEGQWT*S*AS*AS* (SEQ ID NO: 10),
T*S*AS*AS*T*S*PRT*AAAMT*HT* (SEQ ID NO: 11),
AAAMT*HT*HQAES*T*EAS*GQT* (SEQ ID NO: 12),
EAS*GQT*QT*S*EPAS*S*GS*RT*T* (SEQ ID NO: 13),
PAS*S*GS*RT*T*S*AGT*AT*PS*S*S* (SEQ ID NO: 14),
T*AT*PS*S*S*GAS*GT*T*PS*GS*EGI (SEQ ID NO: 15),
GS*EGIS*T*S*GET*T*RFS*S*N (SEQ ID NO: 16) and
GET*T*RFS*S*NPS*RDS*HT*T* (SEQ ID NO: 17),
wherein the asterisk (*) indicates a potential O-glycosylation site, wherein an optional glycan is located at the potential O-glycosylation site and is Tn (GalNAc-α-Ser/Thr), and
c) an all-Tn MUC4 peptide selected from the group consisting of
PVT*S*PS*S*AS*T*GHT*T*PLPVT*DT*S*S*AS*T*GDT*T*P (SEQ ID NO: 18),
LPVT*S*LS*S*VS*T*GDT*T*PLPVT*S*PS*S*AS*T*GH (SEQ ID NO: 19),
LPVT*S*PS*S*AS*T*GHAS*PLLVT*DAS*S*AS*T*GQ (SEQ ID NO: 20),
S*T*GDT*LPLPVT*DT*S*S*V (SEQ ID NO: 22),
PVT*YAS*S*AS*T*GDT*T*PLPVT*DT*S*S*VS*T*GHAT* (SEQ ID NO: 23) and
PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*LS*KT*GALT*LANS*VVS*T*PGGPEG QWT*S*AS*AS*T*S*PDT*AAAMT*HT*HQAES*T*EAS*GQT*QT*S*EPAS*S*GS*RT*T*S*AGT*AT*PS*S*S*GAS*GT*T*PS*GS*EGIS*T*S*GET*T*RFS*S*NPS*RDS*HT*T* (SEQ ID NO: 30), PMT*DT*KT*VT*T*PGS*S*FT*A (SEQ ID NO:3),
PGS*S*FT*AS*GHS*PS*EIVPQD (SEQ ID NO: 4),
S*EIVPQDAPT*IS*AAT*T*FAPA (SEQ ID NO: 5),
T*T*FAPAPT*GNGHT*T*QAPT*T*A (SEQ ID NO: 6),
T*T*QAPT*T*ALQAAPS*S*HD (SEQ ID NO:7),
APS*S*HDAT*LGPS*GGT*S*LS*KT* (SEQ ID NO:8),
S*LS*KT*GALT*LANS*VVS*T*P (SEQ ID NO: 9),
NS*VVS*T*PGGPEGQWT*S*AS*AS* (SEQ ID NO: 10),
T*S*AS*AS*T*S*PRT*AAAMT*HT* (SEQ ID NO: 11),
AAAMT*HT*HQAES*T*EAS*GQT* (SEQ ID NO: 12),
EAS*GQT*QT*S*EPAS*S*GS*RT*T* (SEQ ID NO: 13),
PAS*S*GS*RT*T*S*AGT*AT*PS*S*S* (SEQ ID NO: 14),
T*AT*PS*S*S*GAS*GT*T*PS*GS*EGI (SEQ ID NO: 15),
GS*EGIS*T*S*GET*T*RFS*S*N (SEQ ID NO: 16) and
GET*T*RFS*S*NPS*RDS*HT*T* (SEQ ID NO: 17),
wherein the asterisk (*) indicates a potential O-glycosylation site, wherein an optional glycan is located at the potential O-glycosylation site and is Tn (GalNAc-α-Ser/Thr), and
d) a recombinant MUC4 Tn having the sequence
PMT*DT*KTV*T*T*PGS*S*FT*AS*GHS*PS*EIVPQDAPT*IS*AAT*ZFAPAPT*GNGHT*T*QAPT*T*ALQAAPS*S*HDAT*LGPS*GGT*S*

LS*KT*GALT*LANS*VVS*T*PGGPEG
QWT*S*AS*AS*T*S*PDT*AAAMT*HT*HQAES*
T*EAS*GQT*QT*S*EPAS*S*S*RT*T*S
*AGT*AT*PS*S*S*GAS*GT*T*PS*GS*EGIS*T*
S*GET*T*RFS*S*NPS*RDS*HT*T* (SEQ ID NO: 30), wherein the asterisk (*) indicates a potential O-glycosylation site, wherein an optional glycan is located at the potential O-glycosylation site and is Tn (GalNAc-α-Ser/Thr), and e) a MUC1 Tn/STn/Core3 glycosylated or MUC4 glycosylated mucin peptide selected from the group consisting of
VT(Tn)S(Tn)APDT(Tn)RPAPGS(Tn)T(Tn)APPAHG,
VT(STn)S(STn)APDT(STn)RPAPGS(STn)T(STn) APPAHG,
VT(Core3)S(Core3)APDT(Core3)RPAPGS(Core3)T(Core3)APPAHG,
PMT*DT*KT*VT*T*PGS*S*FT*A (SEQ ID NO: 3),
PGS*S*FT*AS*GHS*PS*EIVPQD (SEQ ID NO: 4),
S*EIVPQDAPT*IS*AAT*T*FAPA (SEQ ID NO: 5),
T*T*FAPAPT*GNGHT*T*QAPT*T*A (SEQ ID NO: 6),
T*T*QAPT*T*ALQAAPS*S*HD (SEQ ID NO: 7),
APS*S*HDAT*LGPS*GGT*S*LS*KT* (SEQ ID NO: 8),
S*LS*KT*GALT*LANS*VVS*T*P (SEQ ID NO: 9),
NS*VVS*T*PGGPEGQWT*S*AS*AS* (SEQ ID NO: 10),
T*S*AS*AS*T*S*PRT*AAAMT*HT* (SEQ ID NO: 11),
AAAMT*HT*HQAES*T*EAS*GQT*(SEQ ID NO: 12),
EAS*GQT*QT*S*EPAS*S*GS*RT*T* (SEQ ID NO: 13),
PAS*S*GS*RT*T*S*AGT*AT*PS*S*S* (SEQ ID NO: 14),
T*AT*PS*S*S*GAS*GT*T*PS*GS*EGI (SEQ ID NO: 15),
S*GS*EGIS*T*S*GET*T*RFS*S*N (SEQ ID NO: 16) and
GET*T*RFS*S*NPS*RDS*HT*T* (SEQ ID NO: 17),
PVT*S*PS*S*AS*T*GHT*T*PLPVT*DT*S*S*AS*T* GDT*T*P (SEQ ID NO: 18),
LPVT*S*LS*S*VS*T*GDT*T*PLPVT*S*PS*S*AS* T*GH (SEQ ID NO: 19),
LPVT*S*PS*S*AS*T*GHAS*PLLVT*DAS*S*AS*T* GQ (SEQ ID NO: 20),
PLPVT*S*PS*S*AS*T*GHAS*PLLVT*DAS*S*AS* T*GQ (SEQ ID NO: 21),
S*T*GDT*LPLPVT*DT*S*S*V (SEQ ID NO: 22),
PVT*YAS*S*AS*T*GDT*T*PLPVT*DT*S*S*VS*T* GHAT* (SEQ ID NO: 23),
and
PMT*DT*KTV*T*T*PGS*S*FT*AS*GHS*PS*EIVP QDAPT*IS*AAT*ZFAPAPT*GNGHT*
T*QAPT*T*ALQAAPS*S*HDAT*LGPS*GGT*S*
LS*KT*GALT*LANS*VVS*T*PGGPEG
QWT*S*AS*AS*T*S*PDT*AAAMT*HT*HQAES*
T*EAS*GQT*QT*S*EPAS*S*GS*RT*T
*S*AGT*AT*PS*S*S*GAS*GT*T*PS*GS*EGIS*
T*S*GET*T*RFS*S*NPS*RDS*HT*T*(SEQ ID NO: 30), wherein the asterisk (*) indicates a potential O-glycosylation site, wherein an optional glycan is located at the potential O-glycosylation site and is independently selected from the group consisting of Core-3 (GlcNAcβ1-3GalNAc-α-Ser/Thr), Tn (GalNAc-α-Ser/Thr), STn/sialyl-Tn (Neu5Acα2-6GalNAc-α-Ser/Thr), Core-2 (Galβ1-3 (GlcNAcβ1-6)GalNAc-α-Ser/Thr)), Core-4 (GlcNAcβ1-3(GlcNAcβ1-6)GalNAc-α-Ser/Thr), and ST/sialyl-T (Neu5Acα2-3Galβ3GalNAc-Ser/Thr), and f) a MUC1 STn and a MUC4 selected from the group consisting of
VT(STn)S(STn)APDT(STn)RPAPGS(STn)T(STn) APPAHG,
PVT*S*PS*S*AS*T*GHT*T*PLPVT*DT*S*S*AS*T* GDT*T*P (SEQ ID NO: 18),
LPVT*S*LS*S*VS*T*GDT*T*PLPVT*S*PS*S*AS* T*GH (SEQ ID NO: 19),
LPVT*S*PS*S*AS*T*GHAS*PLLVT*DAS*S*AS*T* GQ (SEQ ID NO: 20),
PLPVT*S*PS*S*AS*T*GHAS*PLLVT*DAS*S*AS* T*GQ (SEQ ID NO: 21),
S*T*GDT*LPLPVT*DT*S*S*V (SEQ ID NO: 22) and
PVT*YAS*S*AS*T*GDT*T*PLPVT*DT*S*S*VS*T* GHAT* (SEQ ID NO: 23).

3. The method of claim 1, wherein the one or more mucin peptides further comprises an additional peptide, wherein said additional peptide is a peptide from p53, wherein said additional peptide consists of an amino acid sequence comprising at least 5 consecutive amino acid residues of said p53.

4. The method of claim 3, wherein said p53 is human p53.

5. The method of claim 3, wherein said additional peptide is selected from the group consisting of SEQ ID NOs: 52, 53, 54, 55, 56, 57, 58, 59, 60, 61, 62, 63, 64, 65, 66, 67, 68 and 69.

6. The method of claim 1 wherein the step of qualitatively and/or quantitatively characterizing the bound material is by enzyme-linked immunosorbant assay (ELISA) or by a bead assay.

7. The method of claim 1, wherein the one or more O-glycosylated peptides are conjugated to a surface thus forming a glycopeptide array device.

* * * * *